United States Patent 9,567,581 (SELECTIVE REACTIVATION OF GENES ON THE INACTIVE X CHROMOSOME) - sequence listing, part 27

SEQ ID NO: 3436 - DNA, 341416 bp, human
ttccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatct

SEQ ID NO: 3437 - DNA, 341416 bp, human; identical to SEQ ID NO: 3436

SEQ ID NO: 3438 - DNA, 244981 bp, human; identical to SEQ ID NO: 3435

SEQ ID NO: 3439 - DNA, 341443 bp, human; identical to SEQ ID NO: 3434

SEQ ID NO: 3440 - DNA, 423408 bp, human
ttccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaatttgggaatgtcaaagaaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccaggtgttctcacttgtaagtgggagctaaacatcgggtacatatggacataaagatggcaacaatagacactggggactacatgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtgtcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttttaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattgacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccgcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccttagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcagatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttg

SEQ ID NO: 3441 - DNA, 423408 bp, human; identical to SEQ ID NO: 3440

SEQ ID NO: 3442 - DNA, 419526 bp, human
tcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaatttgggaatgtcaaagaaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccaggtgttctcacttgtaagtgggagctaaacatcgggtacatatggacataaagatggcaacaatagacactggggactacatgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtgtcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttttaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattgacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccgcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccttagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcagatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgc

SEQ ID NO: 3443 - DNA, 341443 bp, human; identical to SEQ ID NO: 3434

SEQ ID NO: 3444 - DNA, 244981 bp, human; identical to SEQ ID NO: 3435

SEQ ID NO: 3445 - DNA, 341416 bp, human; identical to SEQ ID NO: 3436

SEQ ID NO: 3446 - DNA, 240675 bp, human
tatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtactt

SEQ ID NO: 3447 - DNA, 341416 bp, human; identical to SEQ ID NO: 3436

SEQ ID NO: 3448 - DNA, 244981 bp, human; identical to SEQ ID NO: 3435

SEQ ID NO: 3449 - DNA, 341443 bp, human; identical to SEQ ID NO: 3434

SEQ ID NO: 3450 - DNA, 240592 bp, human
aggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaa

SEQ ID NO: 3451 - DNA, 413006 bp, human
actagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaatttgggaatgtcaaagaaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccaggtgttctcacttgtaagtgggagctaaacatcgggtacatatggacataaagatggcaacaatagacactggggactacatgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtgtcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttttaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattgacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccgcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtgg

SEQ ID NO: 3452 - DNA, 423408 bp, human; identical to SEQ ID NO: 3440

SEQ ID NO: 3453 - DNA, 423408 bp, human; identical to SEQ ID NO: 3440

SEQ ID NO: 3454 - DNA, 419526 bp, human; identical to SEQ ID NO: 3442

SEQ ID NO: 3455 - DNA, 32875 bp, human
cttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagatagtaataatggctgagaacgaaggtaataatggttaccaagggtggagccattgcgcctgagtggaggggacctttagtggtgagaacgtttcgttcctacttaccactgcgatcttgtgtacattgtttacattccccacctctcttcccagatggttgatatcttacgactctgcttcctagcgtctgctgattgcataggcattgggtgtgagccctcagccactttcattgagtgaaactggccgctgttccccgtgcctcctccctctggtccactcccagcccagcctcccactccgtcccccagaaagcaagggccacaatttgaatgcctagtcaggcttcactgcctcctttttgctcttccagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaagagggtggtggtaagggggaaggaatgatactgaagaatgttgtagggtccacatcaaggagagcctgggatgtgaggaacgtgaagagaaacttgttgctgagaacttggtaaggtgtttgaatcccagctcgacgactgtgattaatcactgtgatttgtggtaagttatttaatctttcagtaccttaatttccccagctgcaaaattcagataataataggttcttcctcataaagtagtttatgaggattaaaagagaaatatatataaagcagttagcccaatgtttgacacagtaaacactcaaagtcaactattattatttgtggctaagagtatgggtcatagagtcagagacctgggtttgagatccagctttacttataatctgttggactttggggaagttatttaacctaactgagcctcagctttcctcatatgtgaaatctaagtaataatggtacagatggtccccgatttgcgatggcttgtcttagaattttttaactttatattggtgcagaagcaatacacagtcaggggaacatcaataaattacatgagttattcaacactttattataaaataggccttgtgttagatgattttgcccaactgtaggctaatataagtgttctgagcatgttgaaggtaaactaggctaagctatgatgttcaataaggtgtattaaatgcgttttcaacttaccatattttccatttatgatggatttattgagatgcagccctattgtaagttgagatgcatgtgtacctatctcagggttaataagcacaaatgggaaaaatcacataaaacagcacaatatctggcatgtggtgagtattctgtaaatgtcagctgctattaggtaggacacgccaaagagcttactctggttggtgactgagatccactgaagagttctgtttcttttttctttattattattattattattattattattatacagagtttcacccttgtcacccaggctggagtgcaatggtgtgatcttggctcgctgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtgccctggctgtttcttttcaaatagtagcatgatcacatttgcattttagctagtacactgtaccagcagttaggaaacagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgaggaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaaaaaaaaaaaaaaaactgcaagagaaagatgagggagtggtcacatctggttggagggatgaagaaaaggtttcagaacataatggcatttgacaccaggcgcggtggcttatgcctgtaatcccaacacttcgggaggctgaggcaggtggatcccttgaggtcaggagttcaagaccagcctggtcaacatggcaaaacgccatctctgcaaaaaaaaaaaaaaaaattatccgggggtggtgatgcactcctgtaatcccaggtactcgggaggctgaggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaaaaaaaaaaaaaaaaagatttttctgaatgtaaaagtcatagtgctcattgtagaaagtttgcaaaacagaagaatattttttaaataaaaaataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccactgcatttgtcttgggtgttaatacttagaaaatccaattgggtggccgggtgcggtggctcactttgggagcctgaggcaggtggatcacctgaggtcaggagttcgagaccagcctggccaacatggcgaaaccccatctctactaaaaatacaaaaattagccaggcatggtggcgggtgcctgtaatctcaggtacttgggaggctgaggcaggagaattgctggaacccaggaggtggaggttgcagtgagccgagatcgcaccattgcactccagcctgggctggcaacagcgagactccgtctcaaaaaaaaaaaaaaaaagaaaagaaaagaaaaaagaaaatccaattgggcaaacagaaagtatctattgttttgatttgcatttctttggcctgccgctttgaacgtttttcttaaatgcctgacagatatcaacacttaactttatactaatgtctcccacattcgtattactagcccagacccctcctgaccttcagacccatacttgcaacacccttccttcatgggtgtttcacagacatgtcataccttgaacccttggctttttaacccccaaatgtgcctcctcacccatctcagtaagtgtaccaccattgacttaggtttttaaaccagaaacctaggatttagcttcaattcctcactttttctgaattttcacatccagtccatcagcaaaggcctttccattccagctacaaaaggtatcttctatccttctatttctctccatctccactatcatacctcagtctaggctaccagcatttctcagctgagatagacaaatcagctccaaggccttgtgtgatctgctgcctgcctcttttcagtctcaccatgtatcattctcccctcgttcactagacttcagccacaatgaccgtctttcagttctttgaatagacccagctctgtccctctatagaatgtctgtgtgtgcagttctctttgcatggaatgctcgtcatatggctaattcttcatcctctaggtctcagcttaaatgtcactcctcaggcctttccagatcagtctctttaagtagttaacaactattattctctctttgcttcatgtttgtttccttcttggcacttgtgtgcagtcatttcatgtgtctttctgagttttgtctctctcccctactacagtatatactctatgagggcacaagccatttcttgttcactatgttatgcctgccatagagcttggcatatagaagttcctcaagcaatgcttattattgacaagcaggagaaacaagatgaacaaaagcccaaagccagggtatatttaggtatgttcaaagactacataatagtctggtttggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttcttcatgtatgtcctctatttcccatatttgaggagtatgagtctgcttgagtaacagcacctccatccttttgagagaaatagagaagtggacgctgggtaagtaatgagtctagttttggatttactgaatttaggtcctaaagtgacaactggatagtcatttccatagacacatttacttgaaatgtgcaagtaaaatttatgagactgttttgtgactgatgtgaaaaatttaggaggcctgtgctttcgttggtgtagatgagtttgccaaggaaaaacatgtagacagaaaaaaagtcaaggataaaactttggggcaagttaagggagaaggaagaggaaggaaagagcaatcagaaactcagtaaggtggctgggtgcggtctctcacacctgtaatcccagcactttgggagactgaggtgggtagatcacaaggtcaggagttcaagaccagcctggccaaggtggcgaaaccccgtctgtactaaaaatacaaaaaaatttagctgggcctggtggtaggcacctgtaatcccagctactcgggaggctgtggcaggagaatcgcttgaacccgggaggtggaggttgccatgagccaagattgcgccactgcactctagcctgggcgacagagcaagaccctgttgcaaaaaaaaaaaagaaactcagtaaggtacaggtacttaaaggagcctggaaaagagaaaacaaatgttatgtcctccttgaagcctttccctaattatcttccctcccagataccatggcatttagttcatgttacttatcacagtataactatctgtcagtctctagacttgaaactcctcaaggtcagagaccttgactgattgtatctcagtatactaattatgtcgttgtatataattgcatccccttggtgcttaacccagtaattggatcatagtgggtacttggaggtgtctttgggagagacagagtggtcataaaaaagatggaagcaaaatgctgtagcggaaaaagcctagacttaggattcagacctggggtaactaatccaatttctaccacttaatagatgtggcatcatttagcaaccccccaccagcctcaatttctttatcagctaacagtgtattgctgctcacaaagcactctgatgtgtgtttttccatttgatccttttaacaaccccatgaaatagacattcttatccccattttagagattaaaaaaaagggggggggctctgagaattgaattgcccaaagttacatagctagtaagtggctaggttaggatttaaacccaggtcttcaaattcccagttctagtatcattcccactgtagcacagaaaagagaagagtaggccaggtgtggtggctcattcctgcaatcccagcactttgggaggacaaggcgggcagattgtttgagtctagaagttcgagaccagcctgggcaatatggtgaaaccctgtctctacaagaaatacaaaaattagctgggtggtggtgcacacctgtagtcccagccactcaggaggctgaggttggaggatggcttgagtctgagaggttgaggctgcagtgagctgtgatcacaccactgtactcaagcctgggtgacagagtagagaccctgtctcaaaaataaagagaagagtgatcatttgaaagggtagaaaaatgagttgagggaaagtgtttctaagacaggggaaaggcaccagtagagtgaaaaactagctgctaatgaccaggaggatgatcaataaatagagtgaggcccggaagaatgtgtggggggtactagattgataacaaaagtggagtggtaaagacattacctttggttgggcacagtggcttgtgcctttaatcgcagcactttgggaggctgaggcaggagggtcatttgaggcaggagttcaagatcagcctgggcaacgtagtgagacccccgtctctacaaaaaaattaaaaattagctgggcatggtgatgtgtgcctgtagtcttagctactcgggaggctgaggtgagaggatcacttgagcccaggagctagaggccaaagtgagctgtcatcacaccactgcactccagcctgcgcaacgaagtgagaccaaaacaaaaaaaacacaaagatattaccttggaaatggcttggtagagacagaatcagctccttaaagacaacagtaaaagaggaagagtgaagttatcgagttgttttttttttttttttttttttgtgagacagagtttcactcttgttgcccaggctggagtgccgtggcgcgacctcggctcactgcaagctccgcctcccgggttcaagccattctcctgcctcagcctccgagtagctgggactacaggcgcccaccaccaaacccggctaattttttgtactttcagtagaggtggggtttcaccgtgttagccaggatggtctcgatctcctgaccttgtgatccacccacctcagcctcccaaagtgctgggattacaggcgtgagccactgcgcccggccgagatggagtttttccttgttaggccggtctcgaactcccgacctcaggcaatccgcctgcctcggcctcccaaagtgctgggattacaggcgtgagccaccattcccggccagttacagagattttatggtgaagagggaaattgaattctacattggctggccatctggtgagtgtgatggtgataatagtcttcacaaaagatgaacgaaaggatggctgagcaagggtgaccactcagccaaagtttgacaatagtgatttgtagttgacccatttgatacaagtttctaattccttaactctcttcaacagcttgggaacagagaaaggaaatggaagttgcccagggtcagaagggttacaaggataggggattctagggtaacagggagtatttccatgtaatggcccaccatggagaatccataacagtgatgaaggtctaagacagtagttttccatatgttccttggagccctaaaatttcactgcaatgcctgggggttgggggggcgggtgttgacagccctcctgatttaaccaaggtaaattttacttgtttattaattatgggagttccgtggcatctctcattagaagaaaaggttcttttactaaaacagttttaaaaacactggcccaaatgaacaagtgttgagttagaagtttaaaagatgatgagcaggctgggcgcggtggctcacgcctggaacgcactttgagaggctaaggcaggcagatcatctgacgtcaggagttcaagaccagcctggccaacatggcaaaaccccatctctactaaaaatacaaaaattagctgggtgtggtggtgcacacctataatcccagctacttgggaggctgaggcaggagaatcacttgaacccaggaggtggaggttgcagtgagctgaaattgtgcggctgcactccagcctgggtgacagaacaagactctatctcaaaaacaaacaaacaaacaaagatgatgagcaaagtcatagaagctaggaagtagaagaaaaggaaggagcagagtgcagtagttaggccttaagcatgcagagaatgggaaaagaaacaaaagaaccttattcagaggactactagactaaccctgaatttaccctgaattatatcaccctaaggtcctcgtatgttatttttttcccgtgacttaggtacatccaggaaagagggttggggataggagtgagattggagttaaacattctcaagtaatatctctgatagcattcatgaactaggaattgtagttctttgtagtgttttactcaaaaagcttcttaggatgatgatgtgtcagttattcgtaacattatagtaaatgtccacttgttaggtaaaaggaacagaagagcctaaacatttttataatagccttttcagaacagtggttcttgacttttttttttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgacctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggtggtgcgcgtctgtgatcccagctactcgggaggctgaggcaggagaattgcttgaacctgggaggcagaggttgcagtgagctgagatcatgccactgcactccagcctgggtgacagaatgagactccatctcaaaaaaaaaaattgtgctgactataatgaaggggaagagaggaagaggatgggaatggagaagaaaggtagaactggaggagagggagaaaagagtaggaagagtgaaataaaagaccagggggatatgcttaggttggaggaggaattagaatttaaccttgccacaatgatgcactgtcacacctttagattacccacgtaggagacacagcaagggcatttccatgcacagaatgtccagtaaactggtaaagaaacctggtgtaacagctttggctatctttgaacatcataaccctgttttggagctgctgcttcaaaagaataggctctgctgccacttgttctttggttcaggacacaacatgaattgggttgaatttatcagcaagtcacaggcatttatttaagtcctcagagaaacctcttcctaatttgatttgtactaattagcccaggagctcttgcctcaggataacatcaacctagttcttcatgttaagagatcaaagaatgaacaattaatattctaaggttataaggccccttgagcatgtctagatgagtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcctttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggagagctaaggaatctctaccgttagtgttctgctgctatatcttagagactgataaatagaaagtgagtgaattttgaatccagagcttttcaagcacctgaagacttaagagcccgtatggtatgttgggtaaaatggcaaattcacctctcataattaatttccttcttaggcatcaacttctaactcatctcgccaggagaggcctccagtgaaacccttcattctcactcggaacatggctcaagccaagtaggtagtactagaaagtttgctttgcagccctctgcttttatggttcaatgtggcaattcattagtgacccacagactgagtggtgttgaaaagtcatgatcttgggtgggcgaggtggctcgtgcctgtaatcccagcactttgggaggctgaggtgggtggatcacctgaggtcgggagttcgagaccagcctgaccaacatggagaaaccctgtctctactaaaaatacaaaattagccggacatgatggcacatgcctgtaatcccggctactggggaggctgaggcaggagaatcacttgaacctgggagggggaggttgtggtgagccgagatcgcgccattgcactccagcctgggcaacaagagcgagactccgtctcaaaaaaaaaaaaaaaaagtcatgatctcacttacggaagttgttcttttatctaagggatattatctttcctgaaactttctccatgtctgtgttcctcagacacttccttcacaaactcaagcttaaaaataggcacacatgggccaggcgtggtggctcacgcctgtaatcccagccctttgggaggtcgaggcaggtggatcacctgaggtcaggagttcgagaccagcctgaccaacatggcaaaaccccgtctctactaaaagtaggaaaataagccaggcgtattggcaggcacctgtaatcccagctactcgggaggctgaggcaggagaattgcatgaacccaggaggtggaggttacaatgagctgagatcaccccactaccctccagcctggtcgacagagcaagactccatctcaaaaaaaaaaaaaaaaagcacacatgtaaacaagcaaataaaacaaaaaaggaaaataattgaatggagaattgtatactttaaagtttttttttattattacattattggcactcttcctgccttcagctacgattctcaaaaggacatatttgcctccctatgatttaattctgagttcttgagatatgtttccctagggtggcgggagtctccttgttttctgtacctttcagagtcaccaactataaatacccattccacggtgtcttcactgctttgtggagcattgccctctgggattgcttaatgggagatgatcctgggctatttatcttctcatgaaagctcttgactttaatgcccctttctggatgcccctttttacatatcctcccatgagtttgtacaactcctcagaagttgactgggtagggaacaaggctgaaacggacacagactttgttgttagagagactttttgtagtactgggttttttttgttatttttgtttttttgtttttttgttttctaaatgcagcgtaatttttgcagagtatttggagctggttatccaagtctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctctccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttggtaattggatcatagtgggtacttggaattgtctttggaaggggaagatgaagagggtggccaccaaaaaggtggaagcaatagggtataaccgaaaaagtatggacagacctgggtgaacagtccaactcctgtcactttttttttttttttttgagacgaagtctcgctcttgccctccaggctggagtgcaatggcgcgatcttggctcactgcaacctatgcctcccgggttcaagcagttctcctgcctcagcctcccgagtagctgggaatacaggcgcctgccaccacgcctggctaatttttgtatttttagtagagatggggtttcaccatgttggccaggctggtctcgaactcctgacctcaggtgatcggcccacctcggcctcccaaagtgctgggattacaggcgtgaaccaccgcgcctggccctcctatcacttaatagatggaatatcttagtccctctgagcttcagtttccttatctcatatattatcccatttgatccttttcaaaaaggaaaaatagagacagggtctcactgtgttttccaagctggtctcaaactcctgggctcaagcaatccttctgcctcagcctcccaaagcattgggattacaggcatcagccaccgcgctcagcttcatttgatcctcttaacaacttcatgaagcagacattcttattctcatttcaagatgagaaagtgctctgggacaaataggtgaaaacaaaaagaaaaaaaataaaaataaataagatgcgctaggcacagtggctcacacctgtagtcccagcactttgggaggccgaggcaggcggattgcttgagctcaggaattcgagaccagcctgagcaatatggcgaaaccccgtcgctaccaaaaatacaaaaaccagccgagcgtagtggtatgcacctgtagtcccatcttctcgggaggctgaggtggtaggatcatgtgagcctgggaggcagaagttgtagtgagccaagatcacgccactgcactccagcctgggtgacagagtgagaccctgtctcaaataaataaataaaatgaggaagtagtcactgggagctgacttaaagtggcctggctaggatttaaaatcagaccttcaaattcccaggttcagttctgtttctactatagcaccaaaaagagaagagtggtaatttgaaaggattagcttttcacctgtgggcagactgcagttactatgatgtaactgcatgtaacttggataggaacttgcagtcttactgtttgaggaatgagagaactgagatcagggtgaatagcaactgaaaaatgaaggaggttatcccagaaaagagagaaccacagagaagatgccctgattctgtatataaaccctactgaaatctctggctgactatgcatgcacagaatggactcttaagcacctcaactaaggctaaaataactgaatggagaattcagctgttgcccaatgcaagggagatagaatttggtattttggttttagacgagttaattgcctgctaaaatgaaaaatcagtactctttagaggaatgaaacagaattcggaatctctacaatatatcatttgtcacgtttagaattcaatcctaagctattagacatgaaaaaaaacaaacaggaaaatgtgactcataactcaaaagaaaaggcaatcaatggataccaaccccaagataactcagatgttggaattagcagacagggactttaaagcagctattatttttatcctcaagggcagagagcaaaatatgtttgtaattaatgaaaagataagaaatctcagcagagaaatagaaactatacacacaaattctggaatggaaaaatacaatatctgaaaatgtaaagtcactggatgagcttaataccagattgttgctgacagaagagcctgtcggttaacttgaagatcaatagaaattatccaatttgaaaaaaaagattggataaaagtaagcagtatctcagtggcctgcggaattatgtacaaaggtctcatgtatgcgcaattggaatgccagtaccagaggagaaagaagggaacagaaaaacttgaagaaatgatgactaaagatttcccaagattcagaaatgtcagcaaaccccaacagtttaaatacaaacaaaatcacacataggcacattatagtcaaactgcagaacaccagagagaaagaggaaattttgaaatcatccaaagataaagtacacattacacataggagaacaaggatatacattattgctgaatttccattaaaaactgtgggcgccagagatggtggaacagcttcaaagtggtggggggaggaacctgtcaacgtataattttatacccagtgaaaaatatccataaaatgaagatgaaattaagacattttcagataaatgagagctaaaagaattcttcaccagaaaattggcattagagaaatgctgaaggaaattcctcaggctgaggggaatggtatcagatagaaatgtaaatactcaagtagtgaagagcagcagaaatggtaattatgtgggtaaatacaaaggactgtcttcctcaacccagtttttaaaaactatacgtagcttctcaaagcaaaaattacaatattgacttgtgaggtttataatgtattaggtgtaatatatgtgacagccatcgcaaaaaggacagggtaaatggaactattttgtttgtgagattctcctgttttatgtgaaccgatacatgtctattgctgtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctgggactacaggcgcccgccatcacacccggctaattttttttttttgtatttttagtagagatgaggtttcattgtgttagccaggatagtctcgatctcctgaccttgtgatccgcccgcctcggcctcccaaagtgctgggattacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcccttgagccgaggagttcaagatcagcttgagcaacatggtaagacccctctccacaaaaaaaaaaaaaaaaaaaaaagttttaaaaaactagccaagtgtgatggttcgtgcctgtagtcccagatactcaggaggctgaggtgggaggattgcttgagcctgtgaggtcgaggctgcagtgagctattatcgtgcccctgcactccagcctgcgtgatagagcaagaccgtgtctcaaaaaaaaaagggagcagcctgattaagaagtgggccaaaaaccttaacagataacctcaccaaagaaagtatacagatgacagataagcatgtgacaagatactctacatcatgtcattagggcaatgcaaattaaacaacactgagataccactatacacctgatagaatggccaaatccagagcacctcaaatgtaaatagaataaaccttcgaattagaagtcagggatcgattatcaggtctagctgcatgctgtctataaaagatacattttaaatacaaagacacagattggttacaaataaaaagaagaaaagatatataggtggctcacgcctgtaatcccaacactttgggaggccaaggcaggcggatcatgaggtcaggagttcaagaccagcatgaccaacatggtgaaaccccatctatactaaaaatagaaaaattagccgggtgtggtggcacacgcctgtaatcccagctactcaggaggctgaggcaggagaatcgcttgaacccaggaggctgaggttgcagtgagccgagaccacaccactgcactccagcctgggtgacagagtgagactctgtctcaaaaaaaaaaaaaaaaaaaaagatatataggttgagcatcctaaatctgaaaatgaaaaacctgaaatgctccaaaatccgaaacttcttaaggctaatgtgatgcttaaaggaaatgctcactgaagcattttggattttcagatttgggatgctcaaccagatatgatgcagatattccaaaataaaaaacaaatctgaaatacttctggtcccatgcatttcagataagggatactcaacctctaccatgctaacagtaagcataagaaagctgcagtagctatagtaatatcagataaagtagatttcaagacaaaaaggtattatcagagattttaaaagggcatttcctactgataaagtggcaatttatcagggagacatagcagtcataaatgcatttgtgcctaataattttcaaattatttacttgaatacttacaggctactgtagggttattcattggcccaatttcaatattgttgtgtctcaaggaacagagaggcctggagcagggttgggacagccagtcagtggagcagtcagaacataacacatttacccattaagttctctgtcttctgtgggcatggtttgtggtgccccagaacaattacactggtaataccaaagaccacagatcaccataacaaatgaaataatgaaaaagtttgagaaactgagaattaccaaaatgtggcacagtgacacaaagtgagcaaatgctcttagaaaaagggcaccaatagacttgctcgctgcagggttgccacaaaccttcaatttgttaaaaaaaaaaaaaaaaaaaaaagtctctgcaaagcacaatagagtgaagcacaataaaacgaggtatgccttcaccttcttttcagatacccatggaacattcaccaaggtagatcatatactggtccatgaaataagtctcaataaattttcaaaaattgaaatcacactgaatatgtcctcagaccacaatggaattaaattagaaatcaataatgtacctagaaaattctcaaatatttgaaaattaaacagtacacttctaaataacctataggtctaagaagaaattagaaagaaaattagaaaatacttctaactgggaataagttcaagagatctgttatacagcatggtgactatcgttaatggctgggtgcggtggctcacgcctgtaatcctagcactttgggaggccgaggcgggtggatcacctgaggttgggagttcaagactaacctggccaacatggtgaaacctcgtctctaataaaaatagaaaaattagccgggcgtggtggcgggcgcctgtaatcccagctattcgggaggccgaggcaggagaatcggttgagtctgggaggcagaggttgcagtgagtcaagatcacaccattgcactccagcctgggcaacagagcaaaactccatctcaaaaaaaatgaaaataaaatacagagtagatgttaagtgttcttactgcaaaaataacaatgtgtaaggtactgcatcttttaattagctagatttagctatcccataatatatacttcaaaacatactgtacacaataaatatgtttgcccatttaaaaataaataaaagagaatactttgaacagaattacagtgaaagtacagcatcagaatttatgggatacaactcgagcaatgctgagatggaaatgtgtgtaactttcaacacttatgttagaaaaaaggaagataaaatcaattacctaaggttttaccttaacaagggtgggggtgggggcatagggaacaaagaaagcccaaagtaaatagatgaaaggaaataaaggcagggaaactaggggtggtcatggttctggtagtaatgcacaaaaattggacacgtgtatactcccatgacctggcagtttcactactcggtatatacctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtgctggttgaaagctagtaagtgttcacccttagttggggatcatgaatggaactggacctacagggtcttctgaggagttagaaatattttgtatcttcatctgggtactgattacatggatgtgttcaatatgtgagaggtcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaattgaaattaagcaggacaggaatagaaaaagaaagaaaaggtccagatgaaattaggagagaggaccagaaccaggaactccaatcaagcaagtaatcatatttctttaattcacatgaaaacagcagaaagggagcccttatgaagttagaaaagctactctgaaccatgcttctttctacaagtttaggaaaacatttcacgtaaaaatgaacaacagattgtggtgatggttgcacaactctgaatataaaacactgaactgttggctcacacctgtaatcccagcactttgggaggcggatcacaaggtcaggagtttgagaccagcctggccaagatggtgaaaccccgtctctactaaaaatacaaaaaaaaaagaaaaattagccgggcatggtggtacgtgcctgtagtcccagctacttgggaggctgaggcaggagaattggcttgaacctgggaggcagaggttgcagtgagtcgagatcgtgccactgcactccagcctggcaacagagtgagactttgtctcaaaaaataaaaaaacaaaaagaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtatccaaaaaagagttggaagatattcagaaaataacataggacatggaaggacaatataaagcaggattagaaaaactcagaaatatgacagcttggggaacatgaatcatttcagaaatataggctaaagtagaaggaaacaagaatgagtgaacacaacagaaaatgccttactatggtaaaaggaaggaaaattttaaaacgaaaaaagataaacagggtttgaggaaaagtgacatatactaaagatagtaaagaagacctggcatatagataataggattatctgaagaagaaagccaaagcaaggaaaaagaataaatgctaaaagttaatattaaggaaagtttcttgggattaaaaaagttgcgcggggggaatctcttggtgttgggtgtgacgcgacccacaggcagccacagcagtgctgtgttccaaggcacgggtgctcagggtggctgtggagcttggtcctgggtccagtgtcttcttgaactgctgcgggacctgtgacatgggtgcaggttcagtctcaggcacaggtggatgctgctctcccaccaaggcaaggactatgactctgaggcacttctcagtagctcgggcccaggggcagggacgtagctgtgattcctaacctgggggtcagggcatagtactggcatggctctggggagggaggggtgttccagacgctcagaccccagggagcagggcacagtggcaattcaggcaccaggaaagaagatgctgtatagtggtgactctggaccctggaagctctatgaggccgggtgcagtggcaacacagccccaggaatggtagggcatagctgtggcttgggctccagggggtgggatgcagtgcaatgttggctttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaaagaatacagatgtaattccaaagaatttagattttttttaaaccctgtagtactccatatgaactcatgagaaattttatttaaaactaaacacacacacacacccacccctgcttttgctctattcactgaaaaggcttagaaacaaggaccagcccagtagcaatgagtatacctagtaactccaattgtgatacagaaatattcttcccaatattctttcttttaagaaatcagggtgtcttagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaatacacacaagtccattgtgatagaaataagtggttgaataagtaaataaatgagggagaagagataaatctcccctacagaaaaatttcaattaattttatgtagatactcctgcttcaaggaggtgtagcatgactgtgtaccccgaaagtgtgggctgtgcttagtgacttgcttccagagactgcaatgtggaaggagacaggagaagtaactttagttggaaacctacaaataccactttggtcaggtcatcgaggttattatcagtgtgaagtcaggttgatagcatatatagtattgtcctccaaaacccataaccctagtctaattctgtaaaaaataggcaacccaaactgagggacattctacaaaatacctgacaagtactcttcaaaactgtccaggtcatcagaatgaaggaaagtctgagaaagagttacatcctagaggagactaaagaaacagacaacaaaatgtactgtggtgacctggataggatcctggaacggaaaagggacattaggtaaaacctaaggacatttgagtaatgtatgcactttagttgttaataatatattagtattggttcattagttgtatcacagaaactgtattaatgtaagaggttgatgataagaaactgggtgtggttatgtaggaactcagtactattttctcaatttttctgtaaattgaaaacttctaaaattaagaagttgatttaaatagttttttaaaacaataattgtgggccgggcgcggtggctcacgcctgtaattccagcactttgggaggcttaggtgggtggatcacttgaggtcagaagttcaagaccagcctggccaatgtgataaaaccccatctctactaaaaatgcaaaaagtagccaggcgtggtggcacatgcctgtaatgccagccactcgggaggatgagacaggagaatcgcttgagcccaggaggcggaggttgcagtgagccaagatcacaccactgcactccagcctgggtgacagagcaagactcctttgtctcaaaaataataataatagttgcaactggctgaaactcaccagatatgtttaaatctctaagttcataattatatatatatatttttatttttttagaggtgggtctcacactctgagcccaggccaggctcaagcaatcctcctgcctcagcctctcgagtgagtaggactacagccatgcactaccatgcctggcagattttaaaagtttttttcttttttataattttttgagccaatataagtgtcataaatattttttttgtagacacagggtctcgccatcttgcccaggatgatctcgaactcctgggttcaagcagtcctcccacctcagcctctcaaagtgctgtgattacaggtgtgagccatcgtgcccagcccataattatattataaaacaagaccaaattattcaacctcagaggctaataagggaacccaatatcttgagaaatggtaaataaagggaaagagtcaagtattttatcttttctactaggtaaccaaatagtagttgatgaggggaaggctctctttgtaaaagtattccagttaattttaaaaagttaaaattaagggtatcacctttttgaaaccccccaataaatgaatgggtctcggcattgagcatcaacagctcctaacattacaacgagacagagatatttacatgcctcctgatgaaggaatgcagcaccacctataattataattcatgctgaagggatcaaacttgagtcaaatcaagcctctgtattcagctgccaatctgcagaaaataaaggaggacatgttagactgcatcatgagtatgcaatcagcaaaatccagtctttgggaaacaaactctacaggtcatatgccccaacttcttcaacagataacttgaaagaaaggggtggagggggaacccatagatttaaaaagatatcaaaacatttttaaataggcaaggctaacctcaaaaatacgatgctaggccaggcgcagtggctcacacctgtaatcccagcactttgggaggccgaggcaggcagatcacttgaggtcaggagttcgagaccagcgtggccaatgtggtgaaaccccatgtctactaaaaatacaaaaattagctgagtgtggtggcaggcacctttaatcccagctactcgggagactgaggcaggagaattacttgaacccgggaggtggaggttgcagtgagccaagatcgcaccactgctctccagcctgggagacagagcaagactgtctcaacaacaacaacaaaaaaaggtgatgatgctaagtgaaagaagtcagccgcaaaagatcacagattacatgattttgatttcatgtgtatgaaatgtccagaataggcacatctatggagacagaaagttgattcatggttctaggagctgggggcagggagggaaggaatgggaattaactgtaaatgggcacaagggatcttttggggttatagaattttttaaattggattgtggtgatagttgcacaactctgtactaaaaaatacattgagtaaaaaaatgaatgtacaaatggacaattacagtgtctagtggtatgcacttgggtgataaagctgtgatgaactctaggaagttattactataaaaagcagtatagaggttacttttgcaggggaggagagttgatttgtataatgtacacagagaggcttttagggtggatacaggagatctgtttcttgacctgagtggaggctataaggcctccttacaaaaatttgttttatatgtacttgtgtggtttccaccatgttttattttatagtaaagggtttaaaagaaaagaacgaggcaaggtggctcacgcctgtaaccccagcactttgggagggccgagaccagcctgggcaacataggggaagaccttgtctccacaaaaaatgtaaaaattagccaagtgtggtggttcatgcctgtggttccagctactcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcacaaaggaaaaaaaatgcaaaagagatgcagcagttggtttaatttcttttgggtgtacactgcatgataaatgccatttggacctcagagcctatttcaagcactgcaaaataatacgtaggcattcttttctggtaggtccaactgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccacttagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 3456 - DNA, 32861 bp, human
gaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagatagtaataatggctgagaacgaaggtaataatggttaccaagggtggagccattgcgcctgagtggaggggacctttagtggtgagaacgtttcgttcctacttaccactgcgatcttgtgtacattgtttacattccccacctctcttcccagatggttgatatcttacgactctgcttcctagcgtctgctgattgcataggcattgggtgtgagccctcagccactttcattgagtgaaactggccgctgttccccgtgcctcctccctctggtccactcccagcccagcctcccactccgtcccccagaaagcaagggccacaatttgaatgcctagtcaggcttcactgcctcctttttgctcttccagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaagagggtggtggtaagggggaaggaatgatactgaagaatgttgtagggtccacatcaaggagagcctgggatgtgaggaacgtgaagagaaacttgttgctgagaacttggtaaggtgtttgaatcccagctcgacgactgtgattaatcactgtgatttgtggtaagttatttaatctttcagtaccttaatttccccagctgcaaaattcagataataataggttcttcctcataaagtagtttatgaggattaaaagagaaatatatataaagcagttagcccaatgtttgacacagtaaacactcaaagtcaactattattatttgtggctaagagtatgggtcatagagtcagagacctgggtttgagatccagctttacttataatctgttggactttggggaagttatttaacctaactgagcctcagctttcctcatatgtgaaatctaagtaataatggtacagatggtccccgatttgcgatggcttgtcttagaattttttaactttatattggtgcagaagcaatacacagtcaggggaacatcaataaattacatgagttattcaacactttattataaaataggccttgtgttagatgattttgcccaactgtaggctaatataagtgttctgagcatgttgaaggtaaactaggctaagctatgatgttcaataaggtgtattaaatgcgttttcaacttaccatattttccatttatgatggatttattgagatgcagccctattgtaagttgagatgcatgtgtacctatctcagggttaataagcacaaatgggaaaaatcacataaaacagcacaatatctggcatgtggtgagtattctgtaaatgtcagctgctattaggtaggacacgccaaagagcttactctggttggtgactgagatccactgaagagttctgtttcttttttctttattattattattattattattattattatacagagtttcacccttgtcacccaggctggagtgcaatggtgtgatcttggctcgctgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtgccctggctgtttcttttcaaatagtagcatgatcacatttgcattttagctagtacactgtaccagcagttaggaaacagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgaggaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaaaaaaaaaaaaaaaactgcaagagaaagatgagggagtggtcacatctggttggagggatgaagaaaaggtttcagaacataatggcatttgacaccaggcgcggtggcttatgcctgtaatcccaacacttcgggaggctgaggcaggtggatcccttgaggtcaggagttcaagaccagcctggtcaacatggcaaaacgccatctctgcaaaaaaaaaaaaaaaaattatccgggggtggtgatgcactcctgtaatcccaggtactcgggaggctgaggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaaaaaaaaaaaaaaaaagatttttctgaatgtaaaagtcatagtgctcattgtagaaagtttgcaaaacagaagaatattttttaaataaaaaataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccactgcatttgtcttgggtgttaatacttagaaaatccaattgggtggccgggtgcggtggctcactttgggagcctgaggcaggtggatcacctgaggtcaggagttcgagaccagcctggccaacatggcgaaaccccatctctactaaaaatacaaaaattagccaggcatggtggcgggtgcctgtaatctcaggtacttgggaggctgaggcaggagaattgctggaacccaggaggtggaggttgcagtgagccgagatcgcaccattgcactccagcctgggctggcaacagcgagactccgtctcaaaaaaaaaaaaaaaaagaaaagaaaagaaaaaagaaaatccaattgggcaaacagaaagtatctattgttttgatttgcatttctttggcctgccgctttgaacgtttttcttaaatgcctgacagatatcaacacttaactttatactaatgtctcccacattcgtattactagcccagacccctcctgaccttcagacccatacttgcaacacccttccttcatgggtgtttcacagacatgtcataccttgaacccttggctttttaacccccaaatgtgcctcctcacccatctcagtaagtgtaccaccattgacttaggtttttaaaccagaaacctaggatttagcttcaattcctcactttttctgaattttcacatccagtccatcagcaaaggcctttccattccagctacaaaaggtatcttctatccttctatttctctccatctccactatcatacctcagtctaggctaccagcatttctcagctgagatagacaaatcagctccaaggccttgtgtgatctgctgcctgcctcttttcagtctcaccatgtatcattctcccctcgttcactagacttcagccacaatgaccgtctttcagttctttgaatagacccagctctgtccctctatagaatgtctgtgtgtgcagttctctttgcatggaatgctcgtcatatggctaattcttcatcctctaggtctcagcttaaatgtcactcctcaggcctttccagatcagtctctttaagtagttaacaactattattctctctttgcttcatgtttgtttccttcttggcacttgtgtgcagtcatttcatgtgtctttctgagttttgtctctctcccctactacagtatatactctatgagggcacaagccatttcttgttcactatgttatgcctgccatagagcttggcatatagaagttcctcaagcaatgcttattattgacaagcaggagaaacaagatgaacaaaagcccaaagccagggtatatttaggtatgttcaaagactacataatagtctggtttggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttcttcatgtatgtcctctatttcccatatttgaggagtatgagtctgcttgagtaacagcacctccatccttttgagagaaatagagaagtggacgctgggtaagtaatgagtctagttttggatttactgaatttaggtcctaaagtgacaactggatagtcatttccatagacacatttacttgaaatgtgcaagtaaaatttatgagactgttttgtgactgatgtgaaaaatttaggaggcctgtgctttcgttggtgtagatgagtttgccaaggaaaaacatgtagacagaaaaaaagtcaaggataaaactttggggcaagttaagggagaaggaagaggaaggaaagagcaatcagaaactcagtaaggtggctgggtgcggtctctcacacctgtaatcccagcactttgggagactgaggtgggtagatcacaaggtcaggagttcaagaccagcctggccaaggtggcgaaaccccgtctgtactaaaaatacaaaaaaatttagctgggcctggtggtaggcacctgtaatcccagctactcgggaggctgtggcaggagaatcgcttgaacccgggaggtggaggttgccatgagccaagattgcgccactgcactctagcctgggcgacagagcaagaccctgttgcaaaaaaaaaaaagaaactcagtaaggtacaggtacttaaaggagcctggaaaagagaaaacaaatgttatgtcctccttgaagcctttccctaattatcttccctcccagataccatggcatttagttcatgttacttatcacagtataactatctgtcagtctctagacttgaaactcctcaaggtcagagaccttgactgattgtatctcagtatactaattatgtcgttgtatataattgcatccccttggtgcttaacccagtaattggatcatagtgggtacttggaggtgtctttgggagagacagagtggtcataaaaaagatggaagcaaaatgctgtagcggaaaaagcctagacttaggattcagacctggggtaactaatccaatttctaccacttaatagatgtggcatcatttagcaaccccccaccagcctcaatttctttatcagctaacagtgtattgctgctcacaaagcactctgatgtgtgtttttccatttgatccttttaacaaccccatgaaatagacattcttatccccattttagagattaaaaaaaagggggggggctctgagaattgaattgcccaaagttacatagctagtaagtggctaggttaggatttaaacccaggtcttcaaattcccagttctagtatcattcccactgtagcacagaaaagagaagagtaggccaggtgtggtggctcattcctgcaatcccagcactttgggaggacaaggcgggcagattgtttgagtctagaagttcgagaccagcctgggcaatatggtgaaaccctgtctctacaagaaatacaaaaattagctgggtggtggtgcacacctgtagtcccagccactcaggaggctgaggttggaggatggcttgagtctgagaggttgaggctgcagtgagctgtgatcacaccactgtactcaagcctgggtgacagagtagagaccctgtctcaaaaataaagagaagagtgatcatttgaaagggtagaaaaatgagttgagggaaagtgtttctaagacaggggaaaggcaccagtagagtgaaaaactagctgctaatgaccaggaggatgatcaataaatagagtgaggcccggaagaatgtgtggggggtactagattgataacaaaagtggagtggtaaagacattacctttggttgggcacagtggcttgtgcctttaatcgcagcactttgggaggctgaggcaggagggtcatttgaggcaggagttcaagatcagcctgggcaacgtagtgagacccccgtctctacaaaaaaattaaaaattagctgggcatggtgatgtgtgcctgtagtcttagctactcgggaggctgaggtgagaggatcacttgagcccaggagctagaggccaaagtgagctgtcatcacaccactgcactccagcctgcgcaacgaagtgagaccaaaacaaaaaaaacacaaagatattaccttggaaatggcttggtagagacagaatcagctccttaaagacaacagtaaaagaggaagagtgaagttatcgagttgttttttttttttttttttttttgtgagacagagtttcactcttgttgcccaggctggagtgccgtggcgcgacctcggctcactgcaagctccgcctcccgggttcaagccattctcctgcctcagcctccgagtagctgggactacaggcgcccaccaccaaacccggctaattttttgtactttcagtagaggtggggtttcaccgtgttagccaggatggtctcgatctcctgaccttgtgatccacccacctcagcctcccaaagtgctgggattacaggcgtgagccactgcgcccggccgagatggagtttttccttgttaggccggtctcgaactcccgacctcaggcaatccgcctgcctcggcctcccaaagtgctgggattacaggcgtgagccaccattcccggccagttacagagattttatggtgaagagggaaattgaattctacattggctggccatctggtgagtgtgatggtgataatagtcttcacaaaagatgaacgaaaggatggctgagcaagggtgaccactcagccaaagtttgacaatagtgatttgtagttgacccatttgatacaagtttctaattccttaactctcttcaacagcttgggaacagagaaaggaaatggaagttgcccagggtcagaagggttacaaggataggggattctagggtaacagggagtatttccatgtaatggcccaccatggagaatccataacagtgatgaaggtctaagacagtagttttccatatgttccttggagccctaaaatttcactgcaatgcctgggggttgggggggcgggtgttgacagccctcctgatttaaccaaggtaaattttacttgtttattaattatgggagttccgtggcatctctcattagaagaaaaggttcttttactaaaacagttttaaaaacactggcccaaatgaacaagtgttgagttagaagtttaaaagatgatgagcaggctgggcgcggtggctcacgcctggaacgcactttgagaggctaaggcaggcagatcatctgacgtcaggagttcaagaccagcctggccaacatggcaaaaccccatctctactaaaaatacaaaaattagctgggtgtggtggtgcacacctataatcccagctacttgggaggctgaggcaggagaatcacttgaacccaggaggtggaggttgcagtgagctgaaattgtgcggctgcactccagcctgggtgacagaacaagactctatctcaaaaacaaacaaacaaacaaagatgatgagcaaagtcatagaagctaggaagtagaagaaaaggaaggagcagagtgcagtagttaggccttaagcatgcagagaatgggaaaagaaacaaaagaaccttattcagaggactactagactaaccctgaatttaccctgaattatatcaccctaaggtcctcgtatgttatttttttcccgtgacttaggtacatccaggaaagagggttggggataggagtgagattggagttaaacattctcaagtaatatctctgatagcattcatgaactaggaattgtagttctttgtagtgttttactcaaaaagcttcttaggatgatgatgtgtcagttattcgtaacattatagtaaatgtccacttgttaggtaaaaggaacagaagagcctaaacatttttataatagccttttcagaacagtggttcttgacttttttttttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgacctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggtggtgcgcgtctgtgatcccagctactcgggaggctgaggcaggagaattgcttgaacctgggaggcagaggttgcagtgagctgagatcatgccactgcactccagcctgggtgacagaatgagactccatctcaaaaaaaaaaattgtgctgactataatgaaggggaagagaggaagaggatgggaatggagaagaaaggtagaactggaggagagggagaaaagagtaggaagagtgaaataaaagaccagggggatatgcttaggttggaggaggaattagaatttaaccttgccacaatgatgcactgtcacacctttagattacccacgtaggagacacagcaagggcatttccatgcacagaatgtccagtaaactggtaaagaaacctggtgtaacagctttggctatctttgaacatcataaccctgttttggagctgctgcttcaaaagaataggctctgctgccacttgttctttggttcaggacacaacatgaattgggttgaatttatcagcaagtcacaggcatttatttaagtcctcagagaaacctcttcctaatttgatttgtactaattagcccaggagctcttgcctcaggataacatcaacctagttcttcatgttaagagatcaaagaatgaacaattaatattctaaggttataaggccccttgagcatgtctagatgagtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcctttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggagagctaaggaatctctaccgttagtgttctgctgctatatcttagagactgataaatagaaagtgagtgaattttgaatccagagcttttcaagcacctgaagacttaagagcccgtatggtatgttgggtaaaatggcaaattcacctctcataattaatttccttcttaggcatcaacttctaactcatctcgccaggagaggcctccagtgaaacccttcattctcactcggaacatggctcaagccaagtaggtagtactagaaagtttgctttgcagccctctgcttttatggttcaatgtggcaattcattagtgacccacagactgagtggtgttgaaaagtcatgatcttgggtgggcgaggtggctcgtgcctgtaatcccagcactttgggaggctgaggtgggtggatcacctgaggtcgggagttcgagaccagcctgaccaacatggagaaaccctgtctctactaaaaatacaaaattagccggacatgatggcacatgcctgtaatcccggctactggggaggctgaggcaggagaatcacttgaacctgggagggggaggttgtggtgagccgagatcgcgccattgcactccagcctgggcaacaagagcgagactccgtctcaaaaaaaaaaaaaaaaagtcatgatctcacttacggaagttgttcttttatctaagggatattatctttcctgaaactttctccatgtctgtgttcctcagacacttccttcacaaactcaagcttaaaaataggcacacatgggccaggcgtggtggctcacgcctgtaatcccagccctttgggaggtcgaggcaggtggatcacctgaggtcaggagttcgagaccagcctgaccaacatggcaaaaccccgtctctactaaaagtaggaaaataagccaggcgtattggcaggcacctgtaatcccagctactcgggaggctgaggcaggagaattgcatgaacccaggaggtggaggttacaatgagctgagatcaccccactaccctccagcctggtcgacagagcaagactccatctcaaaaaaaaaaaaaaaaagcacacatgtaaacaagcaaataaaacaaaaaaggaaaataattgaatggagaattgtatactttaaagtttttttttattattacattattggcactcttcctgccttcagctacgattctcaaaaggacatatttgcctccctatgatttaattctgagttcttgagatatgtttccctagggtggcgggagtctccttgttttctgtacctttcagagtcaccaactataaatacccattccacggtgtcttcactgctttgtggagcattgccctctgggattgcttaatgggagatgatcctgggctatttatcttctcatgaaagctcttgactttaatgcccctttctggatgcccctttttacatatcctcccatgagtttgtacaactcctcagaagttgactgggtagggaacaaggctgaaacggacacagactttgttgttagagagactttttgtagtactgggttttttttgttatttttgtttttttgtttttttgttttctaaatgcagcgtaatttttgcagagtatttggagctggttatccaagtctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctctccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttggtaattggatcatagtgggtacttggaattgtctttggaaggggaagatgaagagggtggccaccaaaaaggtggaagcaatagggtataaccgaaaaagtatggacagacctgggtgaacagtccaactcctgtcactttttttttttttttttgagacgaagtctcgctcttgccctccaggctggagtgcaatggcgcgatcttggctcactgcaacctatgcctcccgggttcaagcagttctcctgcctcagcctcccgagtagctgggaatacaggcgcctgccaccacgcctggctaatttttgtatttttagtagagatggggtttcaccatgttggccaggctggtctcgaactcctgacctcaggtgatcggcccacctcggcctcccaaagtgctgggattacaggcgtgaaccaccgcgcctggccctcctatcacttaatagatggaatatcttagtccctctgagcttcagtttccttatctcatatattatcccatttgatccttttcaaaaaggaaaaatagagacagggtctcactgtgttttccaagctggtctcaaactcctgggctcaagcaatccttctgcctcagcctcccaaagcattgggattacaggcatcagccaccgcgctcagcttcatttgatcctcttaacaacttcatgaagcagacattcttattctcatttcaagatgagaaagtgctctgggacaaataggtgaaaacaaaaagaaaaaaaataaaaataaataagatgcgctaggcacagtggctcacacctgtagtcccagcactttgggaggccgaggcaggcggattgcttgagctcaggaattcgagaccagcctgagcaatatggcgaaaccccgtcgctaccaaaaatacaaaaaccagccgagcgtagtggtatgcacctgtagtcccatcttctcgggaggctgaggtggtaggatcatgtgagcctgggaggcagaagttgtagtgagccaagatcacgccactgcactccagcctgggtgacagagtgagaccctgtctcaaataaataaataaaatgaggaagtagtcactgggagctgacttaaagtggcctggctaggatttaaaatcagaccttcaaattcccaggttcagttctgtttctactatagcaccaaaaagagaagagtggtaatttgaaaggattagcttttcacctgtgggcagactgcagttactatgatgtaactgcatgtaacttggataggaacttgcagtcttactgtttgaggaatgagagaactgagatcagggtgaatagcaactgaaaaatgaaggaggttatcccagaaaagagagaaccacagagaagatgccctgattctgtatataaaccctactgaaatctctggctgactatgcatgcacagaatggactcttaagcacctcaactaaggctaaaataactgaatggagaattcagctgttgcccaatgcaagggagatagaatttggtattttggttttagacgagttaattgcctgctaaaatgaaaaatcagtactctttagaggaatgaaacagaattcggaatctctacaatatatcatttgtcacgtttagaattcaatcctaagctattagacatgaaaaaaaacaaacaggaaaatgtgactcataactcaaaagaaaaggcaatcaatggataccaaccccaagataactcagatgttggaattagcagacagggactttaaagcagctattatttttatcctcaagggcagagagcaaaatatgtttgtaattaatgaaaagataagaaatctcagcagagaaatagaaactatacacacaaattctggaatggaaaaatacaatatctgaaaatgtaaagtcactggatgagcttaataccagattgttgctgacagaagagcctgtcggttaacttgaagatcaatagaaattatccaatttgaaaaaaaagattggataaaagtaagcagtatctcagtggcctgcggaattatgtacaaaggtctcatgtatgcgcaattggaatgccagtaccagaggagaaagaagggaacagaaaaacttgaagaaatgatgactaaagatttcccaagattcagaaatgtcagcaaaccccaacagtttaaatacaaacaaaatcacacataggcacattatagtcaaactgcagaacaccagagagaaagaggaaattttgaaatcatccaaagataaagtacacattacacataggagaacaaggatatacattattgctgaatttccattaaaaactgtgggcgccagagatggtggaacagcttcaaagtggtggggggaggaacctgtcaacgtataattttatacccagtgaaaaatatccataaaatgaagatgaaattaagacattttcagataaatgagagctaaaagaattcttcaccagaaaattggcattagagaaatgctgaaggaaattcctcaggctgaggggaatggtatcagatagaaatgtaaatactcaagtagtgaagagcagcagaaatggtaattatgtgggtaaatacaaaggactgtcttcctcaacccagtttttaaaaactatacgtagcttctcaaagcaaaaattacaatattgacttgtgaggtttataatgtattaggtgtaatatatgtgacagccatcgcaaaaaggacagggtaaatggaactattttgtttgtgagattctcctgttttatgtgaaccgatacatgtctattgctgtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctgggactacaggcgcccgccatcacacccggctaattttttttttttgtatttttagtagagatgaggtttcattgtgttagccaggatagtctcgatctcctgaccttgtgatccgcccgcctcggcctcccaaagtgctgggattacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcccttgagccgaggagttcaagatcagcttgagcaacatggtaagacccctctccacaaaaaaaaaaaaaaaaaaaaaagttttaaaaaactagccaagtgtgatggttcgtgcctgtagtcccagatactcaggaggctgaggtgggaggattgcttgagcctgtgaggtcgaggctgcagtgagctattatcgtgcccctgcactccagcctgcgtgatagagcaagaccgtgtctcaaaaaaaaaagggagcagcctgattaagaagtgggccaaaaaccttaacagataacctcaccaaagaaagtatacagatgacagataagcatgtgacaagatactctacatcatgtcattagggcaatgcaaattaaacaacactgagataccactatacacctgatagaatggccaaatccagagcacctcaaatgtaaatagaataaaccttcgaattagaagtcagggatcgattatcaggtctagctgcatgctgtctataaaagatacattttaaatacaaagacacagattggttacaaataaaaagaagaaaagatatataggtggctcacgcctgtaatcccaacactttgggaggccaaggcaggcggatcatgaggtcaggagttcaagaccagcatgaccaacatggtgaaaccccatctatactaaaaatagaaaaattagccgggtgtggtggcacacgcctgtaatcccagctactcaggaggctgaggcaggagaatcgcttgaacccaggaggctgaggttgcagtgagccgagaccacaccactgcactccagcctgggtgacagagtgagactctgtctcaaaaaaaaaaaaaaaaaaaaagatatataggttgagcatcctaaatctgaaaatgaaaaacctgaaatgctccaaaatccgaaacttcttaaggctaatgtgatgcttaaaggaaatgctcactgaagcattttggattttcagatttgggatgctcaaccagatatgatgcagatattccaaaataaaaaacaaatctgaaatacttctggtcccatgcatttcagataagggatactcaacctctaccatgctaacagtaagcataagaaagctgcagtagctatagtaatatcagataaagtagatttcaagacaaaaaggtattatcagagattttaaaagggcatttcctactgataaagtggcaatttatcagggagacatagcagtcataaatgcatttgtgcctaataattttcaaattatttacttgaatacttacaggctactgtagggttattcattggcccaatttcaatattgttgtgtctcaaggaacagagaggcctggagcagggttgggacagccagtcagtggagcagtcagaacataacacatttacccattaagttctctgtcttctgtgggcatggtttgtggtgccccagaacaattacactggtaataccaaagaccacagatcaccataacaaatgaaataatgaaaaagtttgagaaactgagaattaccaaaatgtggcacagtgacacaaagtgagcaaatgctcttagaaaaagggcaccaatagacttgctcgctgcagggttgccacaaaccttcaatttgttaaaaaaaaaaaaaaaaaaaaaagtctctgcaaagcacaatagagtgaagcacaataaaacgaggtatgccttcaccttcttttcagatacccatggaacattcaccaaggtagatcatatactggtccatgaaataagtctcaataaattttcaaaaattgaaatcacactgaatatgtcctcagaccacaatggaattaaattagaaatcaataatgtacctagaaaattctcaaatatttgaaaattaaacagtacacttctaaataacctataggtctaagaagaaattagaaagaaaattagaaaatacttctaactgggaataagttcaagagatctgttatacagcatggtgactatcgttaatggctgggtgcggtggctcacgcctgtaatcctagcactttgggaggccgaggcgggtggatcacctgaggttgggagttcaagactaacctggccaacatggtgaaacctcgtctctaataaaaatagaaaaattagccgggcgtggtggcgggcgcctgtaatcccagctattcgggaggccgaggcaggagaatcggttgagtctgggaggcagaggttgcagtgagtcaagatcacaccattgcactccagcctgggcaacagagcaaaactccatctcaaaaaaaatgaaaataaaatacagagtagatgttaagtgttcttactgcaaaaataacaatgtgtaaggtactgcatcttttaattagctagatttagctatcccataatatatacttcaaaacatactgtacacaataaatatgtttgcccatttaaaaataaataaaagagaatactttgaacagaattacagtgaaagtacagcatcagaatttatgggatacaactcgagcaatgctgagatggaaatgtgtgtaactttcaacacttatgttagaaaaaaggaagataaaatcaattacctaaggttttaccttaacaagggtgggggtgggggcatagggaacaaagaaagcccaaagtaaatagatgaaaggaaataaaggcagggaaactaggggtggtcatggttctggtagtaatgcacaaaaattggacacgtgtatactcccatgacctggcagtttcactactcggtatatacctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtgctggttgaaagctagtaagtgttcacccttagttggggatcatgaatggaactggacctacagggtcttctgaggagttagaaatattttgtatcttcatctgggtactgattacatggatgtgttcaatatgtgagaggtcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaattgaaattaagcaggacaggaatagaaaaagaaagaaaaggtccagatgaaattaggagagaggaccagaaccaggaactccaatcaagcaagtaatcatatttctttaattcacatgaaaacagcagaaagggagcccttatgaagttagaaaagctactctgaaccatgcttctttctacaagtttaggaaaacatttcacgtaaaaatgaacaacagattgtggtgatggttgcacaactctgaatataaaacactgaactgttggctcacacctgtaatcccagcactttgggaggcggatcacaaggtcaggagtttgagaccagcctggccaagatggtgaaaccccgtctctactaaaaatacaaaaaaaaaagaaaaattagccgggcatggtggtacgtgcctgtagtcccagctacttgggaggctgaggcaggagaattggcttgaacctgggaggcagaggttgcagtgagtcgagatcgtgccactgcactccagcctggcaacagagtgagactttgtctcaaaaaataaaaaaacaaaaagaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtatccaaaaaagagttggaagatattcagaaaataacataggacatggaaggacaatataaagcaggattagaaaaactcagaaatatgacagcttggggaacatgaatcatttcagaaatataggctaaagtagaaggaaacaagaatgagtgaacacaacagaaaatgccttactatggtaaaaggaaggaaaattttaaaacgaaaaaagataaacagggtttgaggaaaagtgacatatactaaagatagtaaagaagacctggcatatagataataggattatctgaagaagaaagccaaagcaaggaaaaagaataaatgctaaaagttaatattaaggaaagtttcttgggattaaaaaagttgcgcggggggaatctcttggtgttgggtgtgacgcgacccacaggcagccacagcagtgctgtgttccaaggcacgggtgctcagggtggctgtggagcttggtcctgggtccagtgtcttcttgaactgctgcgggacctgtgacatgggtgcaggttcagtctcaggcacaggtggatgctgctctcccaccaaggcaaggactatgactctgaggcacttctcagtagctcgggcccaggggcagggacgtagctgtgattcctaacctgggggtcagggcatagtactggcatggctctggggagggaggggtgttccagacgctcagaccccagggagcagggcacagtggcaattcaggcaccaggaaagaagatgctgtatagtggtgactctggaccctggaagctctatgaggccgggtgcagtggcaacacagccccaggaatggtagggcatagctgtggcttgggctccagggggtgggatgcagtgcaatgttggctttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaaagaatacagatgtaattccaaagaatttagattttttttaaaccctgtagtactccatatgaactcatgagaaattttatttaaaactaaacacacacacacacccacccctgcttttgctctattcactgaaaaggcttagaaacaaggaccagcccagtagcaatgagtatacctagtaactccaattgtgatacagaaatattcttcccaatattctttcttttaagaaatcagggtgtcttagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaatacacacaagtccattgtgatagaaataagtggttgaataagtaaataaatgagggagaagagataaatctcccctacagaaaaatttcaattaattttatgtagatactcctgcttcaaggaggtgtagcatgactgtgtaccccgaaagtgtgggctgtgcttagtgacttgcttccagagactgcaatgtggaaggagacaggagaagtaactttagttggaaacctacaaataccactttggtcaggtcatcgaggttattatcagtgtgaagtcaggttgatagcatatatagtattgtcctccaaaacccataaccctagtctaattctgtaaaaaataggcaacccaaactgagggacattctacaaaatacctgacaagtactcttcaaaactgtccaggtcatcagaatgaaggaaagtctgagaaagagttacatcctagaggagactaaagaaacagacaacaaaatgtactgtggtgacctggataggatcctggaacggaaaagggacattaggtaaaacctaaggacatttgagtaatgtatgcactttagttgttaataatatattagtattggttcattagttgtatcacagaaactgtattaatgtaagaggttgatgataagaaactgggtgtggttatgtaggaactcagtactattttctcaatttttctgtaaattgaaaacttctaaaattaagaagttgatttaaatagttttttaaaacaataattgtgggccgggcgcggtggctcacgcctgtaattccagcactttgggaggcttaggtgggtggatcacttgaggtcagaagttcaagaccagcctggccaatgtgataaaaccccatctctactaaaaatgcaaaaagtagccaggcgtggtggcacatgcctgtaatgccagccactcgggaggatgagacaggagaatcgcttgagcccaggaggcggaggttgcagtgagccaagatcacaccactgcactccagcctgggtgacagagcaagactcctttgtctcaaaaataataataatagttgcaactggctgaaactcaccagatatgtttaaatctctaagttcataattatatatatatatttttatttttttagaggtgggtctcacactctgagcccaggccaggctcaagcaatcctcctgcctcagcctctcgagtgagtaggactacagccatgcactaccatgcctggcagattttaaaagtttttttcttttttataattttttgagccaatataagtgtcataaatattttttttgtagacacagggtctcgccatcttgcccaggatgatctcgaactcctgggttcaagcagtcctcccacctcagcctctcaaagtgctgtgattacaggtgtgagccatcgtgcccagcccataattatattataaaacaagaccaaattattcaacctcagaggctaataagggaacccaatatcttgagaaatggtaaataaagggaaagagtcaagtattttatcttttctactaggtaaccaaatagtagttgatgaggggaaggctctctttgtaaaagtattccagttaattttaaaaagttaaaattaagggtatcacctttttgaaaccccccaataaatgaatgggtctcggcattgagcatcaacagctcctaacattacaacgagacagagatatttacatgcctcctgatgaaggaatgcagcaccacctataattataattcatgctgaagggatcaaacttgagtcaaatcaagcctctgtattcagctgccaatctgcagaaaataaaggaggacatgttagactgcatcatgagtatgcaatcagcaaaatccagtctttgggaaacaaactctacaggtcatatgccccaacttcttcaacagataacttgaaagaaaggggtggagggggaacccatagatttaaaaagatatcaaaacatttttaaataggcaaggctaacctcaaaaatacgatgctaggccaggcgcagtggctcacacctgtaatcccagcactttgggaggccgaggcaggcagatcacttgaggtcaggagttcgagaccagcgtggccaatgtggtgaaaccccatgtctactaaaaatacaaaaattagctgagtgtggtggcaggcacctttaatcccagctactcgggagactgaggcaggagaattacttgaacccgggaggtggaggttgcagtgagccaagatcgcaccactgctctccagcctgggagacagagcaagactgtctcaacaacaacaacaaaaaaaggtgatgatgctaagtgaaagaagtcagccgcaaaagatcacagattacatgattttgatttcatgtgtatgaaatgtccagaataggcacatctatggagacagaaagttgattcatggttctaggagctgggggcagggagggaaggaatgggaattaactgtaaatgggcacaagggatcttttggggttatagaattttttaaattggattgtggtgatagttgcacaactctgtactaaaaaatacattgagtaaaaaaatgaatgtacaaatggacaattacagtgtctagtggtatgcacttgggtgataaagctgtgatgaactctaggaagttattactataaaaagcagtatagaggttacttttgcaggggaggagagttgatttgtataatgtacacagagaggcttttagggtggatacaggagatctgtttcttgacctgagtggaggctataaggcctccttacaaaaatttgttttatatgtacttgtgtggtttccaccatgttttattttatagtaaagggtttaaaagaaaagaacgaggcaaggtggctcacgcctgtaaccccagcactttgggagggccgagaccagcctgggcaacataggggaagaccttgtctccacaaaaaatgtaaaaattagccaagtgtggtggttcatgcctgtggttccagctactcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcacaaaggaaaaaaaatgcaaaagagatgcagcagttggtttaatttcttttgggtgtacactgcatgataaatgccatttggacctcagagcctatttcaagcactgcaaaataatacgtaggcattcttttctggtaggtccaactgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccacttagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 3457 - DNA, 53182 bp, human
gggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccaggtaggagtggagggctaggagcaagagcatccgggactcagggagggagtctcgcccctgagactgggagcaagaaaggaagagtcttgcgtggggctttgggctcctccgaggaaagatgcttgtaacaagtgaaggcggtgggccgggaacgtgccctgggagttgggcggatgacactgtgaccttttacagagggcttccttagatgtggttagttttattcgcatttctcatgtgcttgtctgctctcttcagtttggattctaaactccttttggggacctgggatccccctaagaacccaggcgctgcaaccccctggggctacatagtgttagctgctgattaaatatgttgttggggcagcaggtaggaggggtcatagttgatgggtgagattttgagactgcagaagagtgtctgtgaagtaagtgtgcacatcctgtggatgatgagtgcagtcaaccccagggtgactccactgcccctaactgcttcctcttcttgtggtccagggtccatcacacgggttggtaggataggagaatctgggaaggaagaggaccagtgagtgggcctgagatttggtctctggagttcagggtagggatttgttcacccgagagagtaggggactgtccactgggaagttgactgcaagccctcgggaagaagggagggaagaggaactgaaacttggcacctgacagaacagcagccaagcaggtttcaggagacaaagggaggctcagggtatcatacatagggaaccacgtccttactccctacagcaagtatggaccttgttccaggctggccctcaaaggacaacagtccatatctacctagtcctgactcctccactcctttcccaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaggagacaaaggagaggtgggaggatgggaactgtgccagtctaaaatggagagcgagagaccttacttcctccgaggaatgcttcttgagatgaagggagggctaaggactggagaaaacttctcttgtttttatagacatccttagtgacagggaccgggactagacttatctttgaagaggaaatgaatgcctattggatcttaaccctgattggcatttgacctttatgaagataattgttacactagagatgtcgtatcctttaggccttgttttaggggcaaggttggaatattgggaaaggcatctaaacaggcttaggggtggggtacccatctccctctcctaactgctaatgcagaggaccctctttcttgcttttggggtggctcacagcttctctctttggacaggtgaatggagtgaatctgaggaatgcaactcatgagcaggctgcagctgctctgaaacgggccggccagtcagtcaccattgtggcccagtacagacctgaaggtaggagaagggaaggtgggaagagatgatgtgggggagttagacttatattatgtgttggctttttgccatcctaggtaacaaagccacttgaccaggtcccttctacctagagcagtaacctcttcctctctccttttcctgctgggtaggggttggtttgggcggcttgaaagcatcaattaaggctgtgctcagagcctgctgatgtgggctgcagtgcaggagaaggccagtagtgggcagcagcctactggaagcagcatccaaagattagggcgactggaaaaaggggagggggcggagggcccacaggagaagactgggaactgtgtgccctggaagaggagagcagctcttggttagaaggacctcaggtagaagagatccgacctcttaagagatcttgggccaaacctctgtgacccccactcccctcccctcatcaagatgaccgtgaaagacccataaacgcgctgaaaaggtgatactatgcccttgggataggccaactggagtcgactccctcccctccggggggccttctttgtattctcagtgagcagtccttggctggggcgaatgggcggggctggtcatgcaaataaaggcgtttgattggctggggccaaccgaggcccaggtgccgaggtgagccgcgggaaggcgcgccctagcctgcgggccagtggagtggccattggccggctgagggcggcctccagccgcatgccccgccccctgacccaggaggagggcggcaggcgcccctccttccccccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagccagtgaacccaagcccaaacccatactcctgggaacatgtccttcatgtgaggggtgagggggtggaggggggacttgtaggattgttgggagaggcaggattgctgggtttgggggatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 3458 - DNA, 60626 bp, human
agagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaaggcaatggagctgccgtgaatccgtgtggaggagcccatgtgcccggctcgctgagcttcatcccttgatgccatgagtccctctccgtcccagtccctttgtgtgtgaatgtgcacatggatgtgtggagatgtcactctgaatgtggagaggtctctgtagaggaggctgcagggatggctgtgtttgtgtgtgtggctacatgtatatgtgtgtgagcatgtggctgcaagagtgtgcacgcgtgtgcctggtgtgtgtgtgtgagtgtgtgtttgtatgtgttgtctctggtgagaggcgcttgacaggcaagggaggggagaggaaggaggcgagagacatgtcccaagcaaggctgagaggctgctgagaaggacggactcttttgtccaagcagctctgtagtgtgtgtgccggggtggggtggcggggggcggggggagatttgaaggaactgaagcaagcctcctcgctctagagcaggcatggtgcctggagccggcaaggggcagctgccctggtgcagagactggccccagtggggcatgtcccccttgggtacctccagatgtgagagggcttagccccccagccctgacttggcacagcttgggagcccctgggtgctgggcacaactccggcttccactcccagcctaaactgccagcttagaaaatggaaggagcatctgtgggagaagcagcaaaatggaggctgggctggcagagccaggtccctggcacgcaaggcggagggcctgtctggttatccggctctgcagctcctagggtggggagagaggaagaggaggctttgctgtcgagggcaggtgatgacttccccaagctggtgaccgttctggctgcctctgtcctctggggataggatgtgctctcactcagaggcaaaggtggggacttcctggggagaagagccctcagttctggccttctgtctgtccacacttactgctttcccacatcccttgccttggcctcttgccctttccagcgagtccctctctctcctttgccccctctctgtcctggaggcctttctctcgcaaacaccctcttatgcttgtcctgcccggctgggagacaggtggcaatcccaggctgggccagttggccaaggtttctttgccagggctgatccctggatggctcctggccctgagaacaaggtccttgagtaggggtgggggctagagcgtggaccactgggaacgggaagcctctgggtaccactggggctgggcttgaggcatggcttgtcacatgtgggcacacatggtacaccaaatgcacacaagagccacatgggtgtccctttgcttatgtgtctgttgcatggtacttaaggcagctgtgttggtttcgggtctctaaggagccttcagttcttcttcctggggtcacagaccagggtaaggctgtagctggagtcctcccaccaactcccacagctgcagagccagcccagaaatggtggaggcatgatgagctagtcctctctccctctcctcctctctgcttcttgaagccaaagctgtgtggggtggaggtgggacgggggaagcacagcaggacatgtggaggagcccccaccctggtttccagctccccacttctgaggaggaggctagaggtcagggaagggacaacatagccagagaaaggtgggggaggggtgccagggtacctggggagacaggcaagagggcttctccattcttggaggtgaaagtgggagccagcaggcaggtgctgcttgtatgtccagaatcacattttcacttgacaaatagatacacacatgtcctgtctgggaggccatctctgtgggttggccaaatcacccctgtgtttctgaccccttcccttgcctcttcttgcatggctactacatattgaaaaccatggactctgctgccaatcagcctgtgggtcaccaacttctccctcatggggaatcttgtctaccctgctccagtcccacccgtggctttgtctctgactcctgaccagatcccaccctcgccctttctgctgggaaaaacaaagggctcagaatcaaaaatcctttggtagaaaatggattaggactttgactccttctgcctatttgaggaattgggttcctggagtccaagaaagaggtatagagtgaagactcacgaggtgctccaaagtggggcaactgtcctttttcccatgagctctgctggggtacggggatgagtgaccaaaacatcagtggccttaagagcttactgtaatcaaaagaacacctggatatcctattgctctgtcactaattcccagtgtgcccttaggcacatcccatgtcttctctgggcctccgtgtcacctactgtcacataaaggggataggacaagatgatgtctgctgtccttccagttcggacacagtgggagtctatgatcccccagtcagggagaactgtggttcagaaggggaagggttatctgtctaggccactgggtatcccctatggacactgggtgtggcatggtttgcctgccatgctccatctctgccatcccccttaggccaggcctgcacccctcctagtgaaccctgagacactgaagcacagcctctcggtgagtgcaccactggctggctcagtctcagacaattgatctgggctaaatgagcagcttggtttgggctgatatggttggaagcaaagcagggattggtggggtgagtgaggagcggcctcttccaggtcagcctgtcctcatctgtggccaagaggtgacctggggtgcacttgggctcttctactctgtgggagtaggggaggaggcaggttgactaaggggcagatggctggaagggcagggggcactaagggaactgcctgtgtctccccctaggtgaatggcagtgatggcatgttcaaatatgaggaaatcgtacttgagagggtgagtctgccagtggggaaaagcggaaagggaaggagagggttggagccaggataagggagacccctgaatcatggtttcaagacccatggggggacctgcatttagaggatggtgaaacagcggccctcagaggctgcttcactgcatcaatcaatcaacccactaacaaatattaattgaccttgctcactgaggcctggggaattggggaggggatgggtttcccaaaatgatcagcagaggctgggtgtctgacaaatgtgcccagcctgccatggccccttctgaggcctggagaactagctctgggatataaggggagatgaggtacccagaactctcctttgtgccctcagagtgaacagactgtgcctttccacccacttctgcagggcaactctggcctgggcttcagtatcgcaggtggcatcgacaatccccatgtccctgatgaccctggcatctttattaccaagattatccctggtggagcagctgccatggatgggaggctggggtgagatggcctggaagcagggttgtgggtggcagggacaggatcgagatgaggggaggaaagcctgcctggcaggatgacccttccattagatctgagggcggggtgggagggcagaggaggggaggacagagaagtgggaggaagcaggagagggggtggaggggtaggggcacagtgtcatgcctctcgggcttcccccacagggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggtgcggccctccaggttcctgtgctccagccagagccttaggccccagatcccatcttgccccatagggaattggaagggaatggccttactccttgcctgactccccctgttccaactcacagcctacttttttgacctcaggcctcacccttactcatctcaggatggcagcttagcgtttggatcccccggggggagctcctgtggggccagtgggttggctgggggagggggtttggatttgggatcgacaacactttaacctctccttgtggccctctcccacctcctgctggctcccgctcaggcctgggtttcagcattgctgggggtattggcaaccagcacatcccaggagacaacagcatctacatcaccaagatcattgaggggggtgctgctcagaaggatggacgcctacagattggggaccggctgctggcggtgagacagacttcatggggatgcccaaatggtagggtagggaggaggagctccagtaccccttactccgcctaaacctcactcagggatgaggcatcatgggggaatttcaagagttatcatctgtgttgtgtttgcccagatacaaaggccctaattctttctgtggccagggtcttgccctatcccctacctcctgcctctgctcctcacagcactatacttgggcctttgttagcatgctgttgaatttcactgaaaaggcatccctcgagttccctggagaagcctctccttcttccaagtcccagcctgaggcctctcctcttctaggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcagtacgtactcatcagcccctgtccctggtctaaagctctgtcccctggtttctggaggggaagaagttcataccctttgttaagagagggcaagcagctttgctcagtggtggcactgtagcagccaataaggtttatctgaggcgccattattgctaattgaaaactttgctcagtaccccatcgtgaagacttgccatagagtcagcattggcaatttttgacaatttctatggagagtgaattttaaaaagaggagagagagaagccgcagaggatagtgcacagaactgagtccagatcccagttctgtctttgtttttttgtttgtttgtttgagacggagtcttgctctgtcgccaggctggagtgcagtggcacgatgtcagctcactgcgaactccacctcctgggttcaagcaattctcctgcctcagcctcccgagtagctgggattacaggtgcctgccaccatgcctggctaattttttgtatttttagtagagacggggtttctccatgttggcaaggatggtctcgatctcctgacctcgtgatccacccacctcggcctcccaaagtgctgggattacaggcttgagccaccgtgcctggcccccagctctgtcccttagagctgggtgcccttagacaagtccctttcacctgttttttgtttcctctttggcaaaagggagctaatgatgtatgtgctgccttcctcataggactgctgcaaggatcaaatgagatcatggatgagaaaacccttggaaaactgtattaggctatagagatgtgagggattattattagtcacacctctagtcatgcctttctttgtagactgccttgacttcagctctttctaagactcacaggagtgagccaaggatttagaaagggactgcggaggaggaaccctgggtggcgggtggatggagtggggaggtgcggcctgaggaatcagcatcccttggtctcttttgcatctgaagtggggtgtgggggaaagtccttgaggagtttggggtacctccctggaccagtctctgaacttttctctccctttcttgattccagcttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccaggtaagaccccgcccccaacatcccattcaatctacccagaaattggggaggggaggaatccgtttctggccggccacaggctccttgtagtatggcaaagaagaggataaggccctcatcactcccggctttggggtccgaggccctctctcaggccttggggacctagagagggacagaagtggctgcagggacaagctctaccatcagggggagtgccgagtgagtggccccggtccaaaagtgcagataaagaaaggatggggtggagcgtttagggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccaggtaggagtggagggctaggagcaagagcatccgggactcagggagggagtctcgcccctgagactgggagcaagaaaggaagagtcttgcgtggggctttgggctcctccgaggaaagatgcttgtaacaagtgaaggcggtgggccgggaacgtgccctgggagttgggcggatgacactgtgaccttttacagagggcttccttagatgtggttagttttattcgcatttctcatgtgcttgtctgctctcttcagtttggattctaaactccttttggggacctgggatccccctaagaacccaggcgctgcaaccccctggggctacatagtgttagctgctgattaaatatgttgttggggcagcaggtaggaggggtcatagttgatgggtgagattttgagactgcagaagagtgtctgtgaagtaagtgtgcacatcctgtggatgatgagtgcagtcaaccccagggtgactccactgcccctaactgcttcctcttcttgtggtccagggtccatcacacgggttggtaggataggagaatctgggaaggaagaggaccagtgagtgggcctgagatttggtctctggagttcagggtagggatttgttcacccgagagagtaggggactgtccactgggaagttgactgcaagccctcgggaagaagggagggaagaggaactgaaacttggcacctgacagaacagcagccaagcaggtttcaggagacaaagggaggctcagggtatcatacatagggaaccacgtccttactccctacagcaagtatggaccttgttccaggctggccctcaaaggacaacagtccatatctacctagtcctgactcctccactcctttcccaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaggagacaaaggagaggtgggaggatgggaactgtgccagtctaaaatggagagcgagagaccttacttcctccgaggaatgcttcttgagatgaagggagggctaaggactggagaaaacttctcttgtttttatagacatccttagtgacagggaccgggactagacttatctttgaagaggaaatgaatgcctattggatcttaaccctgattggcatttgacctttatgaagataattgttacactagagatgtcgtatcctttaggccttgttttaggggcaaggttggaatattgggaaaggcatctaaacaggcttaggggtggggtacccatctccctctcctaactgctaatgcagaggaccctctttcttgcttttggggtggctcacagcttctctctttggacaggtgaatggagtgaatctgaggaatgcaactcatgagcaggctgcagctgctctgaaacgggccggccagtcagtcaccattgtggcccagtacagacctgaaggtaggagaagggaaggtgggaagagatgatgtgggggagttagacttatattatgtgttggctttttgccatcctaggtaacaaagccacttgaccaggtcccttctacctagagcagtaacctcttcctctctccttttcctgctgggtaggggttggtttgggcggcttgaaagcatcaattaaggctgtgctcagagcctgctgatgtgggctgcagtgcaggagaaggccagtagtgggcagcagcctactggaagcagcatccaaagattagggcgactggaaaaaggggagggggcggagggcccacaggagaagactgggaactgtgtgccctggaagaggagagcagctcttggttagaaggacctcaggtagaagagatccgacctcttaagagatcttgggccaaacctctgtgacccccactcccctcccctcatcaagatgaccgtgaaagacccataaacgcgctgaaaaggtgatactatgcccttgggataggccaactggagtcgactccctcccctccggggggccttctttgtattctcagtgagcagtccttggctggggcgaatgggcggggctggtcatgcaaataaaggcgtttgattggctggggccaaccgaggcccaggtgccgaggtgagccgcgggaaggcgcgccctagcctgcgggccagtggagtggccattggccggctgagggcggcctccagccgcatgccccgccccctgacccaggaggagggcggcaggcgcccctccttccccccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagccagtgaacccaagcccaaacccatactcctgggaacatgtccttcatgtgaggggtgagggggtggaggggggacttgtaggattgttgggagaggcaggattgctgggtttgggggatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 3459 - DNA, 50389 bp, human
ccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagccagtgaacccaagcccaaacccatactcctgggaacatgtccttcatgtgaggggtgagggggtggaggggggacttgtaggattgttgggagaggcaggattgctgggtttgggggatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagc

SEQ ID NO: 3460 - DNA, 20785 bp, human
tttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatg

SEQ ID NO: 3461 - DNA, 37130 bp, human
ctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccc

SEQ ID NO: 3462 - DNA, 43455 bp, human
gcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtga

SEQ ID NO: 3463 - DNA, 58810 bp, human
gcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaaggcaatggagctgccgtgaatccgtgtggaggagcccatgtgcccggctcgctgagcttcatcccttgatgccatgagtccctctccgtcccagtccctttgtgtgtgaatgtgcacatggatgtgtggagatgtcactctgaatgtggagaggtctctgtagaggaggctgcagggatggctgtgtttgtgtgtgtggctacatgtatatgtgtgtgagcatgtggctgcaagagtgtgcacgcgtgtgcctggtgtgtgtgtgtgagtgtgtgtttgtatgtgttgtctctggtgagaggcgcttgacaggcaagggaggggagaggaaggaggcgagagacatgtcccaagcaaggctgagaggctgctgagaaggacggactcttttgtccaagcagctctgtagtgtgtgtgccggggtggggtggcggggggcggggggagatttgaaggaactgaagcaagcctcctcgctctagagcaggcatggtgcctggagccggcaaggggcagctgccctggtgcagagactggccccagtggggcatgtcccccttgggtacctccagatgtgagagggcttagccccccagccctgacttggcacagcttgggagcccctgggtgctgggcacaactccggcttccactcccagcctaaactgccagcttagaaaatggaaggagcatctgtgggagaagcagcaaaatggaggctgggctggcagagccaggtccctggcacgcaaggcggagggcctgtctggttatccggctctgcagctcctagggtggggagagaggaagaggaggctttgctgtcgagggcaggtgatgacttccccaagctggtgaccgttctggctgcctctgtcctctggggataggatgtgctctcactcagaggcaaaggtggggacttcctggggagaagagccctcagttctggccttctgtctgtccacacttactgctttcccacatcccttgccttggcctcttgccctttccagcgagtccctctctctcctttgccccctctctgtcctggaggcctttctctcgcaaacaccctcttatgcttgtcctgcccggctgggagacaggtggcaatcccaggctgggccagttggccaaggtttctttgccagggctgatccctggatggctcctggccctgagaacaaggtccttgagtaggggtgggggctagagcgtggaccactgggaacgggaagcctctgggtaccactggggctgggcttgaggcatggcttgtcacatgtgggcacacatggtacaccaaatgcacacaagagccacatgggtgtccctttgcttatgtgtctgttgcatggtacttaaggcagctgtgttggtttcgggtctctaaggagccttcagttcttcttcctggggtcacagaccagggtaaggctgtagctggagtcctcccaccaactcccacagctgcagagccagcccagaaatggtggaggcatgatgagctagtcctctctccctctcctcctctctgcttcttgaagccaaagctgtgtggggtggaggtgggacgggggaagcacagcaggacatgtggaggagcccccaccctggtttccagctccccacttctgaggaggaggctagaggtcagggaagggacaacatagccagagaaaggtgggggaggggtgccagggtacctggggagacaggcaagagggcttctccattcttggaggtgaaagtgggagccagcaggcaggtgctgcttgtatgtccagaatcacattttcacttgacaaatagatacacacatgtcctgtctgggaggccatctctgtgggttggccaaatcacccctgtgtttctgaccccttcccttgcctcttcttgcatggctactacatattgaaaaccatggactctgctgccaatcagcctgtgggtcaccaacttctccctcatggggaatcttgtctaccctgctccagtcccacccgtggctttgtctctgactcctgaccagatcccaccctcgccctttctgctgggaaaaacaaagggctcagaatcaaaaatcctttggtagaaaatggattaggactttgactccttctgcctatttgaggaattgggttcctggagtccaagaaagaggtatagagtgaagactcacgaggtgctccaaagtggggcaactgtcctttttcccatgagctctgctggggtacggggatgagtgaccaaaacatcagtggccttaagagcttactgtaatcaaaagaacacctggatatcctattgctctgtcactaattcccagtgtgcccttaggcacatcccatgtcttctctgggcctccgtgtcacctactgtcacataaaggggataggacaagatgatgtctgctgtccttccagttcggacacagtgggagtctatgatcccccagtcagggagaactgtggttcagaaggggaagggttatctgtctaggccactgggtatcccctatggacactgggtgtggcatggtttgcctgccatgctccatctctgccatcccccttaggccaggcctgcacccctcctagtgaaccctgagacactgaagcacagcctctcggtgagtgcaccactggctggctcagtctcagacaattgatctgggctaaatgagcagcttggtttgggctgatatggttggaagcaaagcagggattggtggggtgagtgaggagcggcctcttccaggtcagcctgtcctcatctgtggccaagaggtgacctggggtgcacttgggctcttctactctgtgggagtaggggaggaggcaggttgactaaggggcagatggctggaagggcagggggcactaagggaactgcctgtgtctccccctaggtgaatggcagtgatggcatgttcaaatatgaggaaatcgtacttgagagggtgagtctgccagtggggaaaagcggaaagggaaggagagggttggagccaggataagggagacccctgaatcatggtttcaagacccatggggggacctgcatttagaggatggtgaaacagcggccctcagaggctgcttcactgcatcaatcaatcaacccactaacaaatattaattgaccttgctcactgaggcctggggaattggggaggggatgggtttcccaaaatgatcagcagaggctgggtgtctgacaaatgtgcccagcctgccatggccccttctgaggcctggagaactagctctgggatataaggggagatgaggtacccagaactctcctttgtgccctcagagtgaacagactgtgcctttccacccacttctgcagggcaactctggcctgggcttcagtatcgcaggtggcatcgacaatccccatgtccctgatgaccctggcatctttattaccaagattatccctggtggagcagctgccatggatgggaggctggggtgagatggcctggaagcagggttgtgggtggcagggacaggatcgagatgaggggaggaaagcctgcctggcaggatgacccttccattagatctgagggcggggtgggagggcagaggaggggaggacagagaagtgggaggaagcaggagagggggtggaggggtaggggcacagtgtcatgcctctcgggcttcccccacagggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggtgcggccctccaggttcctgtgctccagccagagccttaggccccagatcccatcttgccccatagggaattggaagggaatggccttactccttgcctgactccccctgttccaactcacagcctacttttttgacctcaggcctcacccttactcatctcaggatggcagcttagcgtttggatcccccggggggagctcctgtggggccagtgggttggctgggggagggggtttggatttgggatcgacaacactttaacctctccttgtggccctctcccacctcctgctggctcccgctcaggcctgggtttcagcattgctgggggtattggcaaccagcacatcccaggagacaacagcatctacatcaccaagatcattgaggggggtgctgctcagaaggatggacgcctacagattggggaccggctgctggcggtgagacagacttcatggggatgcccaaatggtagggtagggaggaggagctccagtaccccttactccgcctaaacctcactcagggatgaggcatcatgggggaatttcaagagttatcatctgtgttgtgtttgcccagatacaaaggccctaattctttctgtggccagggtcttgccctatcccctacctcctgcctctgctcctcacagcactatacttgggcctttgttagcatgctgttgaatttcactgaaaaggcatccctcgagttccctggagaagcctctccttcttccaagtcccagcctgaggcctctcctcttctaggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcagtacgtactcatcagcccctgtccctggtctaaagctctgtcccctggtttctggaggggaagaagttcataccctttgttaagagagggcaagcagctttgctcagtggtggcactgtagcagccaataaggtttatctgaggcgccattattgctaattgaaaactttgctcagtaccccatcgtgaagacttgccatagagtcagcattggcaatttttgacaatttctatggagagtgaattttaaaaagaggagagagagaagccgcagaggatagtgcacagaactgagtccagatcccagttctgtctttgtttttttgtttgtttgtttgagacggagtcttgctctgtcgccaggctggagtgcagtggcacgatgtcagctcactgcgaactccacctcctgggttcaagcaattctcctgcctcagcctcccgagtagctgggattacaggtgcctgccaccatgcctggctaattttttgtatttttagtagagacggggtttctccatgttggcaaggatggtctcgatctcctgacctcgtgatccacccacctcggcctcccaaagtgctgggattacaggcttgagccaccgtgcctggcccccagctctgtcccttagagctgggtgcccttagacaagtccctttcacctgttttttgtttcctctttggcaaaagggagctaatgatgtatgtgctgccttcctcataggactgctgcaaggatcaaatgagatcatggatgagaaaacccttggaaaactgtattaggctatagagatgtgagggattattattagtcacacctctagtcatgcctttctttgtagactgccttgacttcagctctttctaagactcacaggagtgagccaaggatttagaaagggactgcggaggaggaaccctgggtggcgggtggatggagtggggaggtgcggcctgaggaatcagcatcccttggtctcttttgcatctgaagtggggtgtgggggaaagtccttgaggagtttggggtacctccctggaccagtctctgaacttttctctccctttcttgattccagcttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccaggtaagaccccgcccccaacatcccattcaatctacccagaaattggggaggggaggaatccgtttctggccggccacaggctccttgtagtatggcaaagaagaggataaggccctcatcactcccggctttggggtccgaggccctctctcaggccttggggacctagagagggacagaagtggctgcagggacaagctctaccatcagggggagtgccgagtgagtggccccggtccaaaagtgcagataaagaaaggatggggtggagcgtttagggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccaggtaggagtggagggctaggagcaagagcatccgggactcagggagggagtctcgcccctgagactgggagcaagaaaggaagagtcttgcgtggggctttgggctcctccgaggaaagatgcttgtaacaagtgaaggcggtgggccgggaacgtgccctgggagttgggcggatgacactgtgaccttttacagagggcttccttagatgtggttagttttattcgcatttctcatgtgcttgtctgctctcttcagtttggattctaaactccttttggggacctgggatccccctaagaacccaggcgctgcaaccccctggggctacatagtgttagctgctgattaaatatgttgttggggcagcaggtaggaggggtcatagttgatgggtgagattttgagactgcagaagagtgtctgtgaagtaagtgtgcacatcctgtggatgatgagtgcagtcaaccccagggtgactccactgcccctaactgcttcctcttcttgtggtccagggtccatcacacgggttggtaggataggagaatctgggaaggaagaggaccagtgagtgggcctgagatttggtctctggagttcagggtagggatttgttcacccgagagagtaggggactgtccactgggaagttgactgcaagccctcgggaagaagggagggaagaggaactgaaacttggcacctgacagaacagcagccaagcaggtttcaggagacaaagggaggctcagggtatcatacatagggaaccacgtccttactccctacagcaagtatggaccttgttccaggctggccctcaaaggacaacagtccatatctacctagtcctgactcctccactcctttcccaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaggagacaaaggagaggtgggaggatgggaactgtgccagtctaaaatggagagcgagagaccttacttcctccgaggaatgcttcttgagatgaagggagggctaaggactggagaaaacttctcttgtttttatagacatccttagtgacagggaccgggactagacttatctttgaagaggaaatgaatgcctattggatcttaaccctgattggcatttgacctttatgaagataattgttacactagagatgtcgtatcctttaggccttgttttaggggcaaggttggaatattgggaaaggcatctaaacaggcttaggggtggggtacccatctccctctcctaactgctaatgcagaggaccctctttcttgcttttggggtggctcacagcttctctctttggacaggtgaatggagtgaatctgaggaatgcaactcatgagcaggctgcagctgctctgaaacgggccggccagtcagtcaccattgtggcccagtacagacctgaaggtaggagaagggaaggtgggaagagatgatgtgggggagttagacttatattatgtgttggctttttgccatcctaggtaacaaagccacttgaccaggtcccttctacctagagcagtaacctcttcctctctccttttcctgctgggtaggggttggtttgggcggcttgaaagcatcaattaaggctgtgctcagagcctgctgatgtgggctgcagtgcaggagaaggccagtagtgggcagcagcctactggaagcagcatccaaagattagggcgactggaaaaaggggagggggcggagggcccacaggagaagactgggaactgtgtgccctggaagaggagagcagctcttggttagaaggacctcaggtagaagagatccgacctcttaagagatcttgggccaaacctctgtgacccccactcccctcccctcatcaagatgaccgtgaaagacccataaacgcgctgaaaaggtgatactatgcccttgggataggccaactggagtcgactccctcccctccggggggccttctttgtattctcagtgagcagtccttggctggggcgaatgggcggggctggtcatgcaaataaaggcgtttgattggctggggccaaccgaggcccaggtgccgaggtgagccgcgggaaggcgcgccctagcctgcgggccagtggagtggccattggccggctgagggcggcctccagccgcatgccccgccccctgacccaggaggagggcggcaggcgcccctccttccccccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagccagtgaacccaagcccaaacccatactcctgggaacatgtccttcatgtgaggggtgagggggtggaggggggacttgtaggattgttgggagaggcaggattgctgggtttgggggatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcac

SEQ ID NO: 3464 - DNA, 60518 bp, human
gctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaaggcaatggagctgccgtgaatccgtgtggaggagcccatgtgcccggctcgctgagcttcatcccttgatgccatgagtccctctccgtcccagtccctttgtgtgtgaatgtgcacatggatgtgtggagatgtcactctgaatgtggagaggtctctgtagaggaggctgcagggatggctgtgtttgtgtgtgtggctacatgtatatgtgtgtgagcatgtggctgcaagagtgtgcacgcgtgtgcctggtgtgtgtgtgtgagtgtgtgtttgtatgtgttgtctctggtgagaggcgcttgacaggcaagggaggggagaggaaggaggcgagagacatgtcccaagcaaggctgagaggctgctgagaaggacggactcttttgtccaagcagctctgtagtgtgtgtgccggggtggggtggcggggggcggggggagatttgaaggaactgaagcaagcctcctcgctctagagcaggcatggtgcctggagccggcaaggggcagctgccctggtgcagagactggccccagtggggcatgtcccccttgggtacctccagatgtgagagggcttagccccccagccctgacttggcacagcttgggagcccctgggtgctgggcacaactccggcttccactcccagcctaaactgccagcttagaaaatggaaggagcatctgtgggagaagcagcaaaatggaggctgggctggcagagccaggtccctggcacgcaaggcggagggcctgtctggttatccggctctgcagctcctagggtggggagagaggaagaggaggctttgctgtcgagggcaggtgatgacttccccaagctggtgaccgttctggctgcctctgtcctctggggataggatgtgctctcactcagaggcaaaggtggggacttcctggggagaagagccctcagttctggccttctgtctgtccacacttactgctttcccacatcccttgccttggcctcttgccctttccagcgagtccctctctctcctttgccccctctctgtcctggaggcctttctctcgcaaacaccctcttatgcttgtcctgcccggctgggagacaggtggcaatcccaggctgggccagttggccaaggtttctttgccagggctgatccctggatggctcctggccctgagaacaaggtccttgagtaggggtgggggctagagcgtggaccactgggaacgggaagcctctgggtaccactggggctgggcttgaggcatggcttgtcacatgtgggcacacatggtacaccaaatgcacacaagagccacatgggtgtccctttgcttatgtgtctgttgcatggtacttaaggcagctgtgttggtttcgggtctctaaggagccttcagttcttcttcctggggtcacagaccagggtaaggctgtagctggagtcctcccaccaactcccacagctgcagagccagcccagaaatggtggaggcatgatgagctagtcctctctccctctcctcctctctgcttcttgaagccaaagctgtgtggggtggaggtgggacgggggaagcacagcaggacatgtggaggagcccccaccctggtttccagctccccacttctgaggaggaggctagaggtcagggaagggacaacatagccagagaaaggtgggggaggggtgccagggtacctggggagacaggcaagagggcttctccattcttggaggtgaaagtgggagccagcaggcaggtgctgcttgtatgtccagaatcacattttcacttgacaaatagatacacacatgtcctgtctgggaggccatctctgtgggttggccaaatcacccctgtgtttctgaccccttcccttgcctcttcttgcatggctactacatattgaaaaccatggactctgctgccaatcagcctgtgggtcaccaacttctccctcatggggaatcttgtctaccctgctccagtcccacccgtggctttgtctctgactcctgaccagatcccaccctcgccctttctgctgggaaaaacaaagggctcagaatcaaaaatcctttggtagaaaatggattaggactttgactccttctgcctatttgaggaattgggttcctggagtccaagaaagaggtatagagtgaagactcacgaggtgctccaaagtggggcaactgtcctttttcccatgagctctgctggggtacggggatgagtgaccaaaacatcagtggccttaagagcttactgtaatcaaaagaacacctggatatcctattgctctgtcactaattcccagtgtgcccttaggcacatcccatgtcttctctgggcctccgtgtcacctactgtcacataaaggggataggacaagatgatgtctgctgtccttccagttcggacacagtgggagtctatgatcccccagtcagggagaactgtggttcagaaggggaagggttatctgtctaggccactgggtatcccctatggacactgggtgtggcatggtttgcctgccatgctccatctctgccatcccccttaggccaggcctgcacccctcctagtgaaccctgagacactgaagcacagcctctcggtgagtgcaccactggctggctcagtctcagacaattgatctgggctaaatgagcagcttggtttgggctgatatggttggaagcaaagcagggattggtggggtgagtgaggagcggcctcttccaggtcagcctgtcctcatctgtggccaagaggtgacctggggtgcacttgggctcttctactctgtgggagtaggggaggaggcaggttgactaaggggcagatggctggaagggcagggggcactaagggaactgcctgtgtctccccctaggtgaatggcagtgatggcatgttcaaatatgaggaaatcgtacttgagagggtgagtctgccagtggggaaaagcggaaagggaaggagagggttggagccaggataagggagacccctgaatcatggtttcaagacccatggggggacctgcatttagaggatggtgaaacagcggccctcagaggctgcttcactgcatcaatcaatcaacccactaacaaatattaattgaccttgctcactgaggcctggggaattggggaggggatgggtttcccaaaatgatcagcagaggctgggtgtctgacaaatgtgcccagcctgccatggccccttctgaggcctggagaactagctctgggatataaggggagatgaggtacccagaactctcctttgtgccctcagagtgaacagactgtgcctttccacccacttctgcagggcaactctggcctgggcttcagtatcgcaggtggcatcgacaatccccatgtccctgatgaccctggcatctttattaccaagattatccctggtggagcagctgccatggatgggaggctggggtgagatggcctggaagcagggttgtgggtggcagggacaggatcgagatgaggggaggaaagcctgcctggcaggatgacccttccattagatctgagggcggggtgggagggcagaggaggggaggacagagaagtgggaggaagcaggagagggggtggaggggtaggggcacagtgtcatgcctctcgggcttcccccacagggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggtgcggccctccaggttcctgtgctccagccagagccttaggccccagatcccatcttgccccatagggaattggaagggaatggccttactccttgcctgactccccctgttccaactcacagcctacttttttgacctcaggcctcacccttactcatctcaggatggcagcttagcgtttggatcccccggggggagctcctgtggggccagtgggttggctgggggagggggtttggatttgggatcgacaacactttaacctctccttgtggccctctcccacctcctgctggctcccgctcaggcctgggtttcagcattgctgggggtattggcaaccagcacatcccaggagacaacagcatctacatcaccaagatcattgaggggggtgctgctcagaaggatggacgcctacagattggggaccggctgctggcggtgagacagacttcatggggatgcccaaatggtagggtagggaggaggagctccagtaccccttactccgcctaaacctcactcagggatgaggcatcatgggggaatttcaagagttatcatctgtgttgtgtttgcccagatacaaaggccctaattctttctgtggccagggtcttgccctatcccctacctcctgcctctgctcctcacagcactatacttgggcctttgttagcatgctgttgaatttcactgaaaaggcatccctcgagttccctggagaagcctctccttcttccaagtcccagcctgaggcctctcctcttctaggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcagtacgtactcatcagcccctgtccctggtctaaagctctgtcccctggtttctggaggggaagaagttcataccctttgttaagagagggcaagcagctttgctcagtggtggcactgtagcagccaataaggtttatctgaggcgccattattgctaattgaaaactttgctcagtaccccatcgtgaagacttgccatagagtcagcattggcaatttttgacaatttctatggagagtgaattttaaaaagaggagagagagaagccgcagaggatagtgcacagaactgagtccagatcccagttctgtctttgtttttttgtttgtttgtttgagacggagtcttgctctgtcgccaggctggagtgcagtggcacgatgtcagctcactgcgaactccacctcctgggttcaagcaattctcctgcctcagcctcccgagtagctgggattacaggtgcctgccaccatgcctggctaattttttgtatttttagtagagacggggtttctccatgttggcaaggatggtctcgatctcctgacctcgtgatccacccacctcggcctcccaaagtgctgggattacaggcttgagccaccgtgcctggcccccagctctgtcccttagagctgggtgcccttagacaagtccctttcacctgttttttgtttcctctttggcaaaagggagctaatgatgtatgtgctgccttcctcataggactgctgcaaggatcaaatgagatcatggatgagaaaacccttggaaaactgtattaggctatagagatgtgagggattattattagtcacacctctagtcatgcctttctttgtagactgccttgacttcagctctttctaagactcacaggagtgagccaaggatttagaaagggactgcggaggaggaaccctgggtggcgggtggatggagtggggaggtgcggcctgaggaatcagcatcccttggtctcttttgcatctgaagtggggtgtgggggaaagtccttgaggagtttggggtacctccctggaccagtctctgaacttttctctccctttcttgattccagcttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccaggtaagaccccgcccccaacatcccattcaatctacccagaaattggggaggggaggaatccgtttctggccggccacaggctccttgtagtatggcaaagaagaggataaggccctcatcactcccggctttggggtccgaggccctctctcaggccttggggacctagagagggacagaagtggctgcagggacaagctctaccatcagggggagtgccgagtgagtggccccggtccaaaagtgcagataaagaaaggatggggtggagcgtttagggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccaggtaggagtggagggctaggagcaagagcatccgggactcagggagggagtctcgcccctgagactgggagcaagaaaggaagagtcttgcgtggggctttgggctcctccgaggaaagatgcttgtaacaagtgaaggcggtgggccgggaacgtgccctgggagttgggcggatgacactgtgaccttttacagagggcttccttagatgtggttagttttattcgcatttctcatgtgcttgtctgctctcttcagtttggattctaaactccttttggggacctgggatccccctaagaacccaggcgctgcaaccccctggggctacatagtgttagctgctgattaaatatgttgttggggcagcaggtaggaggggtcatagttgatgggtgagattttgagactgcagaagagtgtctgtgaagtaagtgtgcacatcctgtggatgatgagtgcagtcaaccccagggtgactccactgcccctaactgcttcctcttcttgtggtccagggtccatcacacgggttggtaggataggagaatctgggaaggaagaggaccagtgagtgggcctgagatttggtctctggagttcagggtagggatttgttcacccgagagagtaggggactgtccactgggaagttgactgcaagccctcgggaagaagggagggaagaggaactgaaacttggcacctgacagaacagcagccaagcaggtttcaggagacaaagggaggctcagggtatcatacatagggaaccacgtccttactccctacagcaagtatggaccttgttccaggctggccctcaaaggacaacagtccatatctacctagtcctgactcctccactcctttcccaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaggagacaaaggagaggtgggaggatgggaactgtgccagtctaaaatggagagcgagagaccttacttcctccgaggaatgcttcttgagatgaagggagggctaaggactggagaaaacttctcttgtttttatagacatccttagtgacagggaccgggactagacttatctttgaagaggaaatgaatgcctattggatcttaaccctgattggcatttgacctttatgaagataattgttacactagagatgtcgtatcctttaggccttgttttaggggcaaggttggaatattgggaaaggcatctaaacaggcttaggggtggggtacccatctccctctcctaactgctaatgcagaggaccctctttcttgcttttggggtggctcacagcttctctctttggacaggtgaatggagtgaatctgaggaatgcaactcatgagcaggctgcagctgctctgaaacgggccggccagtcagtcaccattgtggcccagtacagacctgaaggtaggagaagggaaggtgggaagagatgatgtgggggagttagacttatattatgtgttggctttttgccatcctaggtaacaaagccacttgaccaggtcccttctacctagagcagtaacctcttcctctctccttttcctgctgggtaggggttggtttgggcggcttgaaagcatcaattaaggctgtgctcagagcctgctgatgtgggctgcagtgcaggagaaggccagtagtgggcagcagcctactggaagcagcatccaaagattagggcgactggaaaaaggggagggggcggagggcccacaggagaagactgggaactgtgtgccctggaagaggagagcagctcttggttagaaggacctcaggtagaagagatccgacctcttaagagatcttgggccaaacctctgtgacccccactcccctcccctcatcaagatgaccgtgaaagacccataaacgcgctgaaaaggtgatactatgcccttgggataggccaactggagtcgactccctcccctccggggggccttctttgtattctcagtgagcagtccttggctggggcgaatgggcggggctggtcatgcaaataaaggcgtttgattggctggggccaaccgaggcccaggtgccgaggtgagccgcgggaaggcgcgccctagcctgcgggccagtggagtggccattggccggctgagggcggcctccagccgcatgccccgccccctgacccaggaggagggcggcaggcgcccctccttccccccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccaggtgaggtggggcggacgggggtcaggccccctcgcagtcccccctaacctctctacggctctgttctcagcctcttttccaacactgcgtgccccaattctgccctctccctcgaatgccttcgttgcgtgcccccaggctccttctgagaccctcctcagggcccctcggagcgccgcgcggggctcagcgccccctcaccctacactgggcccagtctggccttcacctcttagccatcacctctcccccacagcgagctgtgcccccttctcaccccagggcctctgtcctgcctcagcccccttcctgctggctgctgcgcccccaagcagctccctaatcccttgccctagaggaattttctaaatcttcccctcccccgacacccatttctccacccaacctgtccacctctgagaacagccgcgaccggcttggtattctgccccctcccttttgtttgcaagggattcgtaccattcccgacttctttcgcctcctcctcccctttgtcccctagggctgcagcgcctgggctcctgggacacctaggccctgtgggccgattactaaggtggaagggaccgacctctccctggcaggtgctctatttccgcgatgagagggggagaggctgggagccccgtcgccaagccgaaagggatggaaagcgcctacctttgtcctttccgttcccctccccccatgctccttcagtgcctcaagatcctgaagggaaagaagagagagcctgcgaccttttccacgaggctcttctgatcgaggacagaagtgcagggaggtaactcacaggagagagagcttgttggtctgaggtaatgagaaagagggatgcaaatggacactttgagtcatttctctccttgtttggttttcagcttactgatcaggaacgcaccttagggatattgtttttttatgatttatgtgtgtgctgttcgctttccagtacagagctaaccgtctgatttttattagcaactaatatttgtgcatttcatgcccacaacttagacaacacaggttctgcaaaggaaatggtttttcttgcgtatttgtgtgtgtatgttgtaggagaaattgatgtttctttcggttttgctctctgatgttgggcacatggaaacaatactgtgaattgtgtgtggtgggggtatgctggatactagtgactacatatttctatgacttgttaggggaatgcaactggcttgcataaaaagctgcaggttgtccagggtaaggggattcctgcagtgtttattgctctctgagcatatttctgagagtttataatgtaggttgaggtgctgttttatgctagttctttctactacttgccaaataaggcctttcttctcttaggatttaggtgaaccactgttgttaaggctctgccaccccaatcaatcttacttcctcctttggtttggtaaatccagcaagtccccaacatgcaaaagcttttttttttttccccttttgaaaacagatccctggagactggtccagagggactgtcaagcattctgtgttgggctctaaattttctttggtaaagtgctagtttttaaaaataaggactccatgttgatcaatttataaacaagtgtggttcttcagaggattacatcacggtgggtatttacaaaatgaataatccaaatacatgtatgttggttggcaagagaccttgcatgtgattggccaagtaagtgttcattacttgaatttttttttcttcacgtgaatgtgagagctggaaaggatcaagtggtccaattcttcattgtgcatactgaaacaatgacaagagagccaagatataacttgtctaagaagggaaagttgctgaaggtcagcatcagagggtcagcaaatcagcttaatcctgaggtctaccagttgggacagaccatgcttgtgaacacctgagggacctaacacctagttaaaagtggaggagcaacaggaaggatactggggaattaacagaggacagactaggaagagtgtaagggaaagaaagatggatgtggaggggaaggttagagtgatctccatggtggcctctgaggcacctttgccaaaccagtgcagcctttagcatgagagatttaaaaaataggtttgactaatagaacaatcagagtaagacaatttgtctcctttttaaaatggtgttattgagaggtaagtcatttaccatacagtttcctcatttagatatatatttcagtgactttaggtatagttgtgcctccatcaccacagtacgttttaggactttttttttttttttgagacggagtcttgctctgtcgcccaggctggagtgcagtggcacgatctcggctcactgcaagctctgcctcccaagttcaagcgattctcctgcctcagcctccccagtagctgggactacaggtgctcgccaccacgcccggctaattttttgtatttttagtagagacggggtttcaccatgttagccaggatggtctcaatctcctgaccttgtgatccgcccgcctcggcctcccaaagtgctgggattacaggagtgagccactgtgcccggcctaaaactttttgtgtgtgtgtgtgagacagtgtcaggctctgttgcccaggctggagtgcagtagcacgatctcggctcactgcaacctctgcccctcaagctcaagccatcctcccacctcagcctcctgagtagctgggactataggtgtgcaccaatacacctggctaatttttgtattttttgtagagatggggtttcaccatgttgcccaggctggtcttgaactcctgggctcaagcattcttcctgccttggcctcccaaagtgctgggattacaggtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtccccagcgtctagtatggagcctggcaaatagtttgttgaattattatctctgtttcagataacttttataagcattaatcttcagaatatccctgtggattaggtggcattatccccattttacaaatgaggaaagtgagggtcagagtggttgagtgacttgctcagggtcacacaagtctgtaagggacagaataaaagtttgagtacagatttctggagaacttctttgagtccagggcttttgtcaccaggccacaactatctccctacccagagacatctggctacagcagaagatatcactctgagactcttcaagtgccagaagctgtcaacaaatgcagtataaatgaactcccaggccgggcgcggtggctcacacctgtaatcccaacacttttggaggccaaggtgggtggatcacgaggtcaagagatcgagaccatcctggccaacatggtgaaattccatctctactaaaaatacaaaaattagctgggtgtggtggcatgcgcctgtagtcccagctactcaggaggctgaggcaggagaatcgcttgaacccgggaggtggaggttgcagtgagctgagatcgtgccactacactccagcctggtgtcagagctgagactctgtctcaaaaaaaaaaaaaaaaaaaaaaaaactcccaaatctcagctttttagtcttgatgaccataaacaggaagaagtaacttgagggtagatggcctgctgggaagcctgagggagatcccttctcaggcagaaggaaagtggatttaggaagactaccagggaatgatactgttgggggaaccccaggaggagccaaaagatgggagttggtttgcctgacttaatagtaaacgtgtgcaggcttaaggatattaatggaataagcaagcattcattttttaattcttcaagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcactctgtcacccaggctggagtgcaatggcacaatctcagctcactgcaacctccgcctcccaggttcaagggattctcctcccaagtagctgggattacagtcacccaccatcatgcccggctaatttttgtatttttgtagagacgaggtttcaccatgttggccaggctggtcttgaactcctgacctcaggtgatccgcccgcctcggcctcccaaagtgctggaattataggcatgagccaccatgcccagccaagggcctacctttttaacaaaaaattgctgattgagatataattcacatgctacaatgcactcattgaaagggtacaacaatttttagaatttttagagttgtgcaactatcatcacaatcaattttagaacatatcaccccaaaaagaagccctgaccccattagcaatcactcctcatcccccccccaccgcccccccagccctaggcaactaccagtctactttctgttttcataaagttgcctcttctggccagttcatataaatgaaatcatgcagtatgtggccttttgtgtttggcttttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgagacggagtttcactcttgttgcccagtctggagtgcagtggcgcaatctcagctcactgcaacctctgcctcctgggttcaagtgattgtcctgactcagccttccaagtagttgggattacaggcatgtgccaccatgcccagcaaattttttatatctagtagagatgagggttcatcatgttggccaggctggtctcgaactcctgtcctcaggtgatccacctgcctcggcctcccaaagtgctgggattacaggcttgagccactgtgccaagcctgagaatgagttatttcttacttaactgtagctttttaggatttctttttggtttaatatgttgcttgttgaaatcttgactctgatattgacactgttcctttgtttaaagctttagtcttatattgcacaatagggtaattgttttttgtaaaatatatcggttttgctccttttatgtgagaatgtatatatgtatgaaatctatatatatataaaatcttggcagaggagccaaggccctgggttctgacttagagtagctgaatgatcttagactagtcaaccttcctcttagggactcaattttttgatctataaaatgaggagactgtgcaaaatggtcactagtgtgtacctcaaattctgtgtcagataagtggtagtgagttgtgaattcaatttacaatttcctatttgtacctggactcttttattgtttaaattagggatggggtcttgctatgttgcccaggctggtcttgaactcttggactcaagtgatccacccaccttggcctcccaaagtgctgggattacaggagtgagccactgcactcagccccttttttaattttaattttaattttatttttttgtatagagacaagatcttactatgttgcccaggctggtcttgaactcctgggctcaaggagtccttccacctcagcttcccaaagtgctaaggttacaggtactgcacccagcatagacttttatttccttccttccttttttctttttcctttcctttcctttcctttcctttcctttcctttctctttcctttcctttctctttcctttcctttcctttctctttcctttctcttttcttttgtctcactttgtcacccaggctggagtgcaatggtgtgatcatggctcactgtagcctcaatttcctgagctccagtgatcctcccacctcagcctgccaggtagctgggactacaggtgcatgctaccacactgctaatttttgtattttttgtagagactgggttttgccatgttgctcaggctggtcttgaactcctgagctcaagtgattccctcgcctccgcctccagcagtgctgggattacaggctttgagccactacccccggccaagactcacagtcttgagctagtaacagtcttgcttatgagggtcttgtcttcccctcttgaaatggacttttgtttattttttgctgaatttaggtatctttaaaaaagcaggccgggtgtggtggctcatgcctgtaattccagcactttgggaggcccagaagggtgaatcacttgagcccaggaattcgagaccggcctggccaaaatggtgaaaccccatctctactaaaaatacaaaaattagccaggcgtggtggtacacccctgtaatctcagctactcaggaggttgaggcaggagaatctcttgaatctgggaggcggaggttgcagtgggctgagatggcaccactgtgctaaaaaagcaaaggccctagagattttatgatttttctacttgatgaaattaagtgataaaaaatttgagtagaaaattaacatattttgtataaatatgtacattaggggcctaagtagacgtcctttggattttcaaaaaggagagaattttgcaaattttgggttaaattccagggtagattaagagttgttttgtaaatattcagaaaaagaagtggtgagcactaggaactggtattggttcaccaaggacaaaaaagtcttgtcagcctgatcaaattttcttgatggacagggttactgggctgtagattagggaaatacggtagatgcactatatctagatttctgcaaggcattcacaaaacttctttggtctacttttggataagatggctgggtgataatggtgataatatgtttaactggacttgtctggaactggttgaatgaatagtcccagaggaaaatgattaatgaagccaggagcagtgtggagagaagtttctagtgcatgtgtgtcctggctttgtccttgagcctgtcctgttcagtctactttcccattctcttcaaattatatttttctcctgcatttaaaagtatattacatttagatttgtggaaaattggaaaatacagaaaaatacaaagtaaagtaaattcaaatcatctgtaaaactatatccagagataaccactgttgtatgtgtatatttctgtgtatttccctctaaacttttatatatttatattacatatatcatataatatgtttgtatctatctgttttaagaaggagattattggctttaagcagttttatgttcttcccattaacttatgtcatgaacattttcctcgatcaccatatattttttgaaaaaaatggtttttaatagttaaataatatttcatcatgtgtgtgccataattcgtataaccattcccctgttggtgaacatttagattatttccaatgttttgatattacacaaaacattctgattgatacccttgtatacggtttttgtgaatctctgattatgttccgaaaagatttttttaaggtggaattaattggatcaaagggtatgaacatacttaaggtttttgatgtatttggccaattagcttccatttccactgacagtataagaatgtctatttcaagatcctcactaatgtggagtattattttttaagacaatttctgtaaatttgataggttaaaaatgttattctttaatttgtattttaatttgtatttcttttgttaataatagggttgaacatttgtgtgcaagtgtttcttggtcatttgtgtgtgtgtgtgtgtgtgtgtgtgtgtgtgtgtgtgtgtgtgtgtggattgcctgttcataccctttccccatttccctattggggtgggttcatcaattcttattgatatataaaagccttaatatggttagaatattaattctttgtcatatatattgcaaagactactcccagtttatagtttgctttctttttttttttttttgtgattgagtcttgctctgttgcccaggctggagtgcagtggtgcgatctcagctcactgcaaccttcgcttcccaggttcaagcgattctcctgcctcagcctcctgagtagctgggactacaggtgtgcgccaccacactcggctgatttttgtattttttagtagagagggggtttcaccatgttggccaggctggcctcgaactcctggcctcaagtgatctgtccacttcagcctcccaaagtgctgggattacaggtgtgaggcactgcgcccagcctgttttttaaattttatcttgatgtacagatgtttcatatgtttttatgtggtcaaatctattaatgttttgtatattttgcctgtgcccagaggtttagaagggccttgcctacccgagggcaaataaatactgtccgagttttattctagttatttaatatttttgtttttgtatttgttatttttttagagacagggtctggctttgtcacccaggctggagtgcagtggcatgatcatagatcactggaaccttaaactcctaggctcatgtgatcctcctgcctcagcttcccaagtagctaaggaccacaggcacatgctaccaagcatggctaatttttgtggtttttttgtagagatggggtctcactgtgttgcccaggctgctctctcaaattcctggcctcaagtgattttcctgccttggcatctcaaagcactgggattacagccaagagccactgtgcctggcctgtttttgtgtttaaaaccttaacttgcctggagttgatttgtgatgtaaagtagggtactaacttaatttcttccaaatgttaatgaattacctcagtaccatttgttagataatccatcatttctctgcatttttgaagtaccacctttattataaataaaattcttttatacacacacacacacgatttggactttaatattttacttttggattatcagttactgaaaaatgaccataggtgttttgacaacttagatgagaagagtatttctccaggtcccattttctgagtttcttccacagaaacttgacctaaaggagattcagttgagtttgtgatcctgtgggtgtgacaactgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaagagtttagaattatttgcagatttgaagatttccctctctaaattatatttaaaaattaaatcagactagttctaactttgattccgtatggacctcattgatttggtcataaaatcataatgatgtcataattagaagggatcttagaaattatctagttttagaggtgttagacaacacctctaaacaatggacccatcattagaaactaacccaagtaataggcttcattattattattttcagacaaggtgttactctgacacccaggctggagtgcagtggtgtgatcatagctccctgtagccttgaacccctgggctcaagcgatcctcctgcttcagcctcctgagtagttgggactacaggcgtacaccaccacgcctgactaattctcttattttttttgcaaagacagggtctcaatatgttgtgcaggttggcctcaaaatcctggcctcaagcaatcctcacaccttggcctcccaaaatgttatgattacaagtgtgagccactgcatctggccccataactattttataaagacaagtttgtgattcctagaaatgttctgatatttggcaattcatatacttactccatactaacaagtatcttcttaatgggcttattttactttcacctccatccatttctttcttttttttttttttaagatggtgtctcactctgtcacccaggatggagtgcagtggtgtagtctcggctcactgcaacctccccctcccaggttcaagtgattctcatgtctcagcctcctgagtagctggcattacaggagcccaccactatgcctggctaattttttgtatttttttttagtagagatggggtttcaccatgttggccaggctggtctcgaactcctgacctcaagcaatccacctggctcagcctcccaaagtgctgggattacaggcgtgagccaccgcgccagcccatccatttctttttaaaatatgaaccatagtgtgaaggtttatactccaaaggcaaatataggaacctaaaccacaattcatactcctcaaattctgtgactctctctgaggctgtaacttcacttccaccagagttctgttatttttcacaattggtgacttatttctttgagcctcagggcagctcagcaatggcaaatgagggctgtatgagtttgagatttgaatgtctgcacttccataagatggaaagaactttttgggcagcagttgatttattttgaggttataggcaactaaaacacgagccattattcagccatgtcttccctactcaatatttgtgtgggaactcaaggtcaagaagatacagttctctatttcactttatttttatttgcatcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttgcagtgagccgagatcacaccactgcactccagcctgggtgacagaacgagactcctgtctcagaaaagaaaaagaaaaaaaaagaattagagagcttcccagtattggacatgtttgagcagaggctgaagggctagctggtttggatgctgtaagagcaggggcttcttatactaggggctgtggagaatacacaaacatagaaagcatgtgcttcgtctgtcaagaaacttaaatgtagatataagacacttcacttattctctccacagtagccaaagtgacacacatatctgatcatgtccttccgttccttaaaatcattcaatggcttctttccattgagaaagaatttatcttaggataaaagcaaataacctgtccgggcgcagtggctcacacctgcaatcccagcactttgggaggccgaggtgggcagatcacctgaggtcaagagttcaagaccagcttggccaacatggtgaaaccctgtctctactaaaaatacaaatattagctgggagtggtggcaggcgcctgtaatcccagctactcaggaggctgaggcaggagaatcgcttgaacctaggaggtggaggttgcagtgagctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctggactcagcttaaatgtcacttcctcagggaaacctttgttgaactccacccccttcccacaggtaggttaagtcaccctattagtctctctcttagcattttcttcatcacagttatcacaattgtaattaaataattgtttgttttgtaattgtaatttctagggaccattttgattaccattatattctcagcagctagcacaatgcctgatacacagtagacattcagtaatttttttttatttttttttatttttagagacagcatctcactctgtcacctaggctggagtccagaggtgtgatcatagctcactgcagcctcaaactcctgacctcaagtgatccttctacctcagcctctcgagtagctaggactataggtgtgcaccaccatgcccagttaatttttgaattttttgtagaattggggtctcattatattgcccaggctggtcttgaactcctggtttcaagcaatacttctacctcggcctcccaaagcattgggattacaggtgtgagtcactgtgcccaaacttagaaaatatttgaataaataaatgaatgaataaaacttcttggaatgaggtaggaaagatggtgaaggatgtaaaggttgttcagtgtcaggcaggggagaaatgtttcaggagcagggaataacaggtagaactgaacaagctgtattcaaggggtccaggcaagctagctcaaaagaagacctgtgtaattcagatgtgggatagataggctggctgtgatgggaggatggttgtagcagtccttgaaagtttggctgacatagtaaaagtaaaattctttagtgctcattgagtcgttatagatacttggacaggggggctacaaattcaagctttaggaaagcttttcaaataagaatctaatctggattgagtttgtaaagccttggggcagaagaccagttagggaggtacagcagtggcccagagaagagataataaaatagtcaagggaaaattaagacacgaaatcaacagtacggcaatgacaattaaaagtataaagaaatagattgaggaagcaattaggaagaaacatcagcaaaatttgaggaaacactggttgtatgcagggaaaagggggtgtcgtttacagtaatgggggtttggcatgaggaaaaaaaaggcttggttttcaagttgggggcagatttaatgtagtcaaattaggtagatacttatagaggtagatatagtgtcatgtaggtggaacagcgtcttaactcatggttaaacagggccagggaaagagggagagaaagacctgtggactaaggcctaacctggagaaccagcaactccactcaccaagaggacaccttttctattataatgcagacaacattttagctcctctttgtccattccagaataaaatctttacttttgcataaccaaaaggctcattaaactgtttttctccaaacaaaagatcaatttgtcctcaaaggtaaattctgcctccacttcagaaacagaaaaagtgctggaagagtggaatagtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatggaaaaaaaagtgaataaaacacaatttaataaacttgaaattttagcagcacatgtaaaaacaaaaagcgtatgccttagagcaatagctttgttctctttctgtagtctattttaagtgggccctctggcccagaattatcagccttggattaggagctttgaggaaatggtggtttcgtggttgttttttaaaggatttttaaagaaatgtagttactaagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatgaacagcagcatgagctctgggtctgggtccctccgaacaagtgaaaagaggtccttgtatgtcaggtaagttgcccttcagagcactagcccttgtgctggacgaggagagctccatgccaacccagcccttcttatttaactagtgggctagggagtatgtactcccagttctaaaataacgcttctcactgtatgcttaggttgtgtattttatggtcagtgtctcctcccttttgtgagctggcttcttccttttagctcatgaatgactcagtatgggaaaatttcagtttgctctaattgtaaaagactgttgggtgattgttgctagtcagcattcaaatatcagtcaaatgttcaaagtactttgcttgcaatctgtgctttgaggggaaacttgccacccccccatccccttccatgtatgcataatagacatcaggatttgtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggcaacgtgacaactgctctgtccttggggtgtgagaggacaatagtgaagggatgtcaacgctaattgcagtttttctcatggtgcttgcttttctttttccccagttggtggtccctgactctaccgcagggagtggagctaaaggagcccatctctgagcctgaagcccactagaacccttcacaatctttcctaatgtgaaccctcaactccaccccttgtgtgttgaaagcatgtgctatgcttacctcccgctgtgaagggagaatggtaggaaggcgggactagtcactggtcatttttccaattccccggaaaggaaagttttgttttctgtcactaaagcccttgctcccagtctgcagcctggatactggggtgctgatgggtgaaatcagaaatgcactgtcgaccccccaaaataggtaatggttatatgacttggtcaggattgttccgttccgtgcttccagcccccgcagatgtggcactccagtgtgcgtgggaagctgctctttaggcaagacagtttctttggagagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattcttaaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatacatgtgtggtgtttttttttttttttttttttttgacggagtctcgctctgtcgcccaggctggagtggagtgcagtggcgcgatataggctcactacaagctccgcctcctgggttcacgccattctgcctcagcctcccgagtagctgggactacaggcgcctgccaccacacccggctgattttttgtatttttagtagagacagggtttcatcgtgttagccaggatggtcttgatctcctgacctcgtgatccgcccacctcagcctcccaaagtgctaggattacaggcatgagtcaccgcgccctgcccaggaaaatatatgtttttaacaagcaatcaaggctgggtgtggcagctcacaccagtaatcccagcactttgggaggccaagataggaggattgcttgagcccaggagttcgagaccagtctgcacaacatagtgagccccactcttaaaaagtaaaaagtttttaattagccaggtgtggtggcatgtgtctgtagtcccagctactcagggggctaaggcaggaggatcacttgagcccaggaggttgagacttcagtaagctatgatcatgacactgtattccgtcctgggtaacagagcaagaccttgtctctataaaaaattataaaaaataaacatcacacttactttagctcctactatgtagaaagcagtaaaacacaaggctaagaatttgggcacagttgcagggtatattcaaggaagcagcgggtatggtccctgccctctggcagttcgccatctacccagaaaagatttaagcggcaggtggttaaagtgagggaaccctttttcagtttgggtgtcacctctgattattttgctgtcgctttccctatgacatgattattttgctttccttcccctcccctgagtatctatctccctttggtgtacatgtgtttgcaaagctattttgaagtaaataacactctcttagagctgcaacagaggctctaacaggtgaaaccctagggagctgcagctgtactaaccacaggggacgtggggtttgtagagcagggagcaggaggaagaaggaacgagagcagtatttggagaatgaaatttgattttaaagtcatcagtgacttatttggaaggaccttcctcacacttcactatgctagaattatctcttaagtagatgaccgggataagcacagcacctcagtctgcccagcctagggcttttgctctgctggaggatttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctagattgcaggtagaaaaatacaaacttctcactgaaatcacccatttgtggtgactccatatgaagacaggttccactggatgtgaaaagtagaaactttttttttggctttttttttttgagacagagtcttgctctgtcgcttaggctggggtgcagtgtcgtaatcttggctcactgtaacctccacctctcaagttcaagtgattctcctgcctcagcctcccgagtagctgggactgcaggcatgcaacatcacacccagctaatttttgtagttttagtagagatggggtttcaccatattggccaggctgctcttgaactcctgacctcaggtgatccacccgcctcagcctcccaaagtgctgggattacaggcgtgagcctctgcgcccgacctcctaaggctcttttgatgtgtcactcctctcagatttccaggggccactagatcttgtctattcaagggcttccaaaatttgcttcagacctttatttccaataccatttcctaggacttctagcatcagccaagctggtgtccttttccataagcctggattgtatagctccctccccaccttctcccaccttcccttttatttctttactctgcatcatttatagcatgtcacaacagcatgtcttgtcagaagacctgggttttgtcccaggttggttagatgtatgacctaggtcaaactattttttcctccctgaacctctgtttccccatatgtaagagaaagagaccgcactaggtgacttctatggtcccattggtcttttcaaccctaccattctgtgctttttctttggctgcccgaggacatagggccctttctttagtgcttcaggagtgtttaccagtcattgtttgggattgtagttaacattttttgtcctctctttagctactttttgaagatatgtttgtgaactgagaaagcgccctgctagagctagtttcctaggatgtgggtgagggagagggctattgagcgagttctactttggacttttatcttgcatccagaagccaagaggagatggggtttgtaaaatattttctcttatgcttcttattgggagaatgagatgtttctttgaaagcgggtgcatatttaccactttggctcagaaagaaggatgtggtctcctggagacatccttctagtatactgtgaggctgctatgtctgtgctgtttgggttggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccatttactggcagtaacaggacttctttctgattccaaaacagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcctcagttagaatgaatgttggaggcactgaggtgggactggtcccagggtcagcctccaggaagtgcctggcactagcagtggaagtgccagacagagctctgctgtggtggtgaggaacggttttttagctagactgtcagggtcaggaaaatggtttttcaagagaacaaggtctagggactcagtgttgctctcctggtttcttcctcttgtgttttctttcccttaacttcactcatgtatgtcaagagaagagccttttcttcccaggatccctggagttggggctacttctggaatcccatgcacgtgcataagcatacaggatatccacacaactctcagcagactcgctgtcatcctagagtgcctacagagccagttttcccaggagaatccttcctgcttaaatgagttgacatggaaggagtgttgctccacattgttcaaataaagatctattgagaaacacaaagttggttcggtaggaagagcagtcacactgagctaaattcaacggaagaagaaatttaatcctgataaatcttcttgctctaccgtgtgcctcagcaattaactgctccaaccttaaccttaaacaccaggtctggcttgaaaaatgtcttctcacttgtctcatcatgaacagtaaacatctctcatttaccagtgactcctctgtcttacatggagggatcttggggtcttggtctattggggctggcaggagactgactggttctgataggaaatgtccttctgtcaggccagcttggtccacagtcatggtatgtgtaagtcattgctatctggggtggtacctggtggacagaagggtgccctcatctagatggcagccacggctcatcatcctggagtagttcaatgagaagccatagacggggtggctctgctcatgagcagttaggagacagtctgagtcagaggcctgaggtgatgtcaccatagtttcatcagatgagtcccagagtccctccatgccaagcccagcctggggaggtgttcattgctcagtggtcccgcctggtgggcgagggggtatctactggatgacagagttgaaggtgcctagtgcttctccagaagctgagctcatcccccaagatctgtccagctcagggcagctttggaggccacactctacaccatgcgaaacttttcctgaagggtttgaacagagtgaatcagtattgggcaaaggcttcttgaggtgatggcaattctatctgcctacctggcacacgcggacatttgctctttcacgcactgcagagggaaatggtgatttcaggggcaaacagagacctgggctccacaaccaaaatttagtcaaagcaggtgctctaagccttggagtgtcacctgtcctgtcccattggcctacagctgtagacacctcagaaagctagtctactccaaggccctctggcaatgaattgggcagcatgaagtcttgatgtcttatctgccctgggatgttctttctgtggcaaagttcctggcctcactatagtgctaggtcttcatggtgtttcataattctgtcactagtgctcacctacctctgtattcttcctccccccttgtctttttctctattttttctcttctccccaaatctctccctctcttccattccctcccatcccttccccttcccccctcttctccccgtcgtcctctctccgcccttgctgtctgtgaaatcaggacttcccggggttaagtgacgattattatggagcaaagaacctgagtaagtccaacttacacaccgttcactgtacttgtggcatgaatggagatagtgggggtggggctattggggacatgggtgagggtgaagggtgaggggagggcagtgtttgtgagcactctgacatcacagcaggaagaagtgcatgtggctccatatgttacatgtttgctatggatccctagtacccaaataagtccatatcattcatgcctttgtttaccttttgctactcaaagtgggagggcgtgagcatggcatcccaccttagaagtgaagtaagcttgaaatgtttctccaaggtaaccactcagctaatctctagcctattgtcgaagggaggggtgcctgctggttggattcttctcccagtgataccacgctaaagaattgggtgtaggaattgcagctgttaacagtcctctaactaggggcaagggtactgtgacccctttttcccaacctgcatctgagatgtcccagcagatcccgggcctcagcaaacagccactgtttggcttcccacagagcacctgtaaggggttgagctggtctgctaggggcctcagcatcatttatggaccatatatagttagtgctttatctcaggaaaactccaacctcattttcctttctggaaaagaatcctggagtggaaaatgaaaaagacctagatgatgaggccttagtggccatcctgctgcgtgcaagggtgcacagacaccaaatgggttctatcagcatatactctccttcaataaataatacagaccaaaggcaaaggagttgcccatggggattgttcaggaactagccatgtgtggcaactcagccagtcctttctgggtgggggggccacagcatatcatggtctggaacagtgtggtcttggctgaaatgagcagcatctctctccatagtttggtgtgtccatgtctcatcttcattcgcgtgtcatcttggatgggcgggctttgtttgtgcctcctacgagcgctgctcctccgcctgagctttcttttccctcaccactaagagatgggcagatcccagctgtgtgagacaggagggctgccttgtcctcaaggtgtttttgttggttttgttgtctgtgttttgacatatgtgtctggtggtggatggagatgcttcccctctcaccactgaagccaggctctcctgctttggagtggtggcaggaaggctggggagcccaccgaatggtcagagcagcgctccctggtgtctgcttaacccatccagcgtttggcctcttagttgtggagtgccacatggttctgtacttcaggggctctgttgggcgggggacacccatgagcagactggtccctggacttctctttgctcctgtcactgtcttttctttcctgttgttagccttgggagatgcattttgaaatacgatttggaaaccatccaggtcaatttgattcagatgaagaggatgctgctgaaggaagtatggcttgtagtacatagggagggacttggcagaccaagagggctctggggacaagtacgagagggccaggggctcaggattggagctgtgcctcccagttggtagcctggatgtggcaggcctctggtggcctgactcagttggcagctcagtgtctcgctcctggagcatttgagttttgtgctgcatgtgacctctcagtggtgtgttctgaattggagtctctttcttgttggcttgcagagggagtgacatccaacaccagtgacagcgaaagcagttccagtaagtgtgtgtcattccttccatgtcgtgtagctccactgtgtatcccagccatcctcattccagtgttgcacagctgccattgctgctcagaggctggtgcttcttttagccatgtacactttgagatcctagaaatgctgtggccagttcattctccttatgggttggggttcaccccatggattaaaggagagtataagccctatagtgctggccgggacctgacttaaaagcatccctggcactgggaagggtaaactgccaaagagtaaatccctgccatgggtactgtgggccataggtgctgccaggtttatagatttgctcagagaccaaaagaaaaatggctcctctaggacactgccctaaatctgcctttccaggtcattaggacctctttgcctttggggccagttaaaggatgaggtaattgccaagttctccttgggagatcctgtgaccagaccagagaaaccgtaattcaaacctcatgaactttgggagcactggtttttcaggagctatggtggctagaagccttgtaaaatctgcccaggaatattaggctcagaagaagccttttagcaagcattgtgtgccttgatgcaaatatcactgttttccctgggactgccatcagccactttgggacctccaggcacccagcaccgagtggcttgacgactgttttaggaaaacctcaacattgctaggctcgacatggggctccaccaggaagagacagcaggttcagcattgctcttaaagggcactggggaccttagcagagccatgtgccacttttctggatgctgcttccaatgcaggaggtgggttggtagacctttaaaagggcaaagttaggctgcttggggacctgggtgtgtgccctgactcccctgcatgttgatgaaggggactcgggcaagcatctcaaccagtcaaagtgtccctgtcattcttaccagagcaagggggctactgcacacagctgacttgttacctacaagaagagttcctcacaaattggggtggtttggggtggaggcttcatggcttctgggccttggccctttgcccagtgatatttcactgaacaagagaactgctgactcctgtctcagagccagtgaagggtttcatgtgctttctcaccagcagaaaacagaaaggatcacaggtggtggcaaggaccacctgataaggctgtgtcctggcaggggaggggtacggggagtactgtacagaaggaggcagatcatatggtgctaacctatctctcttttttgttgcagaaggacaagaggatgctattttgtcatatgagccagtgacacggcaagaaagtaagcctcctctgagagccttgtcttcgtgctggtctcctggtcgtggggctcaatacagtgggtggctgtggcagcagagggagggacctggaggaggaggaaggcttgactcatggcacatccagcccctgggctccttcttctctatgcttcttcctagtgtcatagggaagggggtgcatccagtgtgcacttctctctgtgcctttgcctgctgccaggacaccttccaaaggagggggcaaatttacaaggaaagtctatttcagtagatgtagccactgctaaaagagaggtccaggttcttcccttcagtggctgctctgcaaaaaccttgctcagttactggtgtcagtgcagagattttttctgactctgttagaaggggagcagcttccggtttcagacttgccttgaacttagatattctcaaattaaaggctctttgatgtctttctgtttaaaagccagacaatgtctgaggatgctttaccctgtctgagtctctgctccagagcctctgtgttctagccagactcaggggtaggacaggctgtctggtgggggcctctgttcactgtctcgatgctctccctctctagttcactatgcaaggcctgtgatcatcctgggcccaatgaaggaccgagtcaatgatgacctgatctccgaatttccacataaatttggatcctgtgtgccacgtaagagtccaggaaggcccagaggagtgaggcttggtgccctgggaattgttgctctaatgttttatggaaaaggtctgggatcagattctagggctatttggggacagggtacatttgacacgctggaaaacagtaggtggcaatatattccccaaaagctgatggggttggagagattaagccatcaggcttggctgctcactcttgaggggaagtttcagtggtgatggttgagaatgattggacaaatacggaggcccagccaaagtggtgttgatgtgactccattaacagtttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagccagtgaacccaagcccaaacccatactcctgggaacatgtccttcatgtgaggggtgagggggtggaggggggacttgtaggattgttgggagaggcaggattgctgggtttgggggatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 3465 - DNA, 8701 bp, human
agcagcagccaggtgtggcagtgacagggaggtgaggagactgggggctgagggaggtgggccagggagggctgatgtggcacagtgggccggaaataggggccgggtcttgccttctactgacctccgccttcagccacttaggtcccttccatgcttccctctgaagctggggtgaggcccctcctgccaggtgccagacttgcttagcctctctctgcagcctctttccaggttcaacattgcttttcctctcactttttttcctctggccaaagattccccttattcccatagggccagattctcaggaagacttgagggaccccctaggtgcaaggtggccaagtttgtctctctgagacatttcctgccacacagggttagggtttagtgggaatgttgggcactgccaggtgctgttttccttccttgattacaaggcaagccaggcatgcacccaacacggggctgcgagtggatgaataaagcgtgctcagcgggctgcagagggctagccaacagggccaaggatttgggagcgtgtgtttccactttcttgaaggaggcagactgactcaagctgaacttggagtaattgatggttcggagattttttttttttttttgagacggactttcactcttgttgccctggctggggtgcaatggcgcaatctcggctcactgcaacctctgcctcccgggttcaagcgattctcctgcctcagcctcccgagtagctgggattacaggcatgcaccaccatgcctggctaattttgtatttttagtagagacggggtttctccatgttggtcaggctggtctcaaactcccaacctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgacatagggatcagttctccttccaaaggtaacagcaaaaattgagatcacagcacccagacaagggtccttagaggccccacagggagctactggctatgtcccagaagactcaagaagaaaaaaggcggggagttacaagaacctagaaactcaggggtggccaggatgtctgtggcacacccctgaagggcagagaagagaacagctaaggtttgctttgcagtttgaggaagcagcccaagaaaggtaaggaaaggaaaagcagaccaaatcaagaggcagcagaaaatcctgggacagaaggagagggaaagagttgtcaattgctacaacaaaagtaccttagaaaaaaaagagctgggccaggcacagtggctcacgcctgtaatcccagcactttgggaggctgaggcagcaggattacctgaggtcaggacttcgagaccagcctggccaacatggtaaaacaccatctctactaaaaatgcaaaaattagccaggtgtggtgacacgcacctgtaatcccagctactcgggaggctgaggcaggagaatcatttgaacccaggaggcggaggttgcagtgagcagagagcgtgccactgtactccagcctgggtgacagagcaagactccatctcaaaaaaaaagaaaagaaagagttgtcaattgataggaaaggggagaaggggctaaaagaaaataagacatagcagttttgaatctccctgttccttttttttttttttttcaatctccctgttcctaaaaagtacccacagaaagaaaagttatacctgtagccaagtagagcttatgggaaagagtatgtgctctgcgagaatcacttgaacccgggaggcggaggttgcagtgagccgagatcgcgccactgcacttcagcctgggctacagagtgagaccctgtctcaaaagaaaaaaaaagtgtgtggccaggcacggtggctcacgcctgtaattccagcactttcggaggccgaggcgggcggatcacgaggtcaggagatcaagaccatcctggctaacacggtgaaaccccatctctactaaaaatacaaaaaaattagccgggcgtggttgcgggggcgcctgtagtcccagctactcaagagtctgaggcagaagaatggcgtgaacccagggggcggagcttgcagtgagccgagatcgcgccactgcactccagcctgggtgactgagctagactccgtctcaaaaaaaaaaaaaaagtgtgtgttctggagtcagcttgacctggttcaaatcccagctctatcacttactgactatgtgactcttagataagtcctttcacctttctttgcctctgtttgctcatctgtgatatgaggataaagcaacacttacctcaaaaagttcttttaaggattaaatgacagtgcatgtgcaggggcctggcatataacaggtactcagtaaatttttttttaataaaaatgctacaatgttgaggtggtcttattattattattattattattattattattattattttctgagacaggctggagtgcagttggcgcaattgaagctcactgcagcctcgacctcttggactcaagagatctgcctgccacagcctcttaagtagctaggactatgggtgaatggcaccagccaccatgcctggataatttttgtgtttctttttttgtagagatggggtctcactatgttgcctatggctggtcttgaactcctagactcaagcgatactcctacctctgcctccttttaattttttttttaagagacgggggtctccatatgttgcctaagaataacctggccaggggccaggcgcggtggctcacgcctataatcccagcacttagggaggctgaggcaggtggatcacgaggtcaggagatcgagaccatcctggctaacgtggtgaaaccccgtctctactaaaaatacaaaaaaaaattagccaggcgtggtggcgggcgcctgtagtcccagctactcgggaggctgaggcaggagaatggcgtgaacctgggaggcggagcttgcagtgagctgagatcgcgccactgcagtccagcctgggcgacagagcgagactccctctcaaaaaaaaaaaaaaaaaaaaaagaataacctggccaggttattcttttattattattattatttcttttattcttttttttttttaagaggcagagtctcgttctgtcgcccagcctggagtgcagtggtgggatctcagctcactacaacatctgcctcccgggttcaagcgattctcctgcctcagcctcctgagtagctggaactacaggcatgcgccaccacgcccagctaattgttgtatttttagtagagacatggtttcaccacgttggtcaggctggtctcgaactcctgacctcaggtaatccaccagcctctgcctcccaaagtgctgggattacaggcgtgagccactgtgcctggccttttttttttttttttttttttgagacagccggctaatttgagacacctggctaattttttgtatatttagtagagacggggtttcaccatgttagccaggatggtctcgatctcctgacctcgtgatccacctgcctctgcctcccaaagtgctgggattacaggcgtgagccactgtgcccggcctttttttttttttttaaatataatagagacgagggtcatgctatgttgcccatgatggtctcaaactcctgggctcaagcaatccacccacctcagcctcccaaagtgctgggattcgaggcgtgagccactgcgcctggcctaggttttgtttgtttgtttgtttgtttgtttgtttgtttgttcgtcttttccgagacggagtctcactctttcccccaggctggagtgcagtgacgggatctccactcactgcaacctctgcctcctgggttctaacaattctcctgcctcagcctcctgagtagctgggattacgggtgcccgccaccacacccagctaatttttgtatttttagtacagacggggtttcaccatgttggtcaggctggacttgaacccctcagtgatctgcccgcctaagcctcccaaagtgctgggattgcaggcgtgagcccctgcacccagccggttattcttaataattctctggccacctgttctagagtgtaacacatctcaccacctgaagcatttcttttctttctttgtttctttcctttttttttttttttttttttttttgagacagagtctcgctctgtcaccaggctggagtgcagtggcgcaatctcggctcactgcaatctccgcctcctgggttcaagcaattctcctgcctcagcctcccaagtagctgggattacaggtgcatgccactacacccagctaatttttgtaattttagtagagacgaggtttcaccatgttggcctcgatctgctgacctcgtgatccgcccgccttggcctcccaaagtgttgggattacaggcgtgagccaccttgcccagcccctgaagcatttctttatggctaactgtggtgcctagtgcagcagctttgcatatagaatcccaggcttgggagaaagggcacccatagccctgcttccccatgctggttggcacatgacatgaactcactaaggctttttatttatttatttatttatttatttatttatttatttatttagctaaatgaagaaaccttgttctgagaagtaacctatgtcctgtggactgtccttctttccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagttt

SEQ ID NO: 3466 - DNA, 10006 bp, human
ggctgggctgacagtacctggtggcatagggcagacacgcctgcagacattctctgggaaagggcagcagcagccaggtgtggcagtgacagggaggtgaggagactgggggctgagggaggtgggccagggagggctgatgtggcacagtgggccggaaataggggccgggtcttgccttctactgacctccgccttcagccacttaggtcccttccatgcttccctctgaagctggggtgaggcccctcctgccaggtgccagacttgcttagcctctctctgcagcctctttccaggttcaacattgcttttcctctcactttttttcctctggccaaagattccccttattcccatagggccagattctcaggaagacttgagggaccccctaggtgcaaggtggccaagtttgtctctctgagacatttcctgccacacagggttagggtttagtgggaatgttgggcactgccaggtgctgttttccttccttgattacaaggcaagccaggcatgcacccaacacggggctgcgagtggatgaataaagcgtgctcagcgggctgcagagggctagccaacagggccaaggatttgggagcgtgtgtttccactttcttgaaggaggcagactgactcaagctgaacttggagtaattgatggttcggagattttttttttttttttgagacggactttcactcttgttgccctggctggggtgcaatggcgcaatctcggctcactgcaacctctgcctcccgggttcaagcgattctcctgcctcagcctcccgagtagctgggattacaggcatgcaccaccatgcctggctaattttgtatttttagtagagacggggtttctccatgttggtcaggctggtctcaaactcccaacctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgacatagggatcagttctccttccaaaggtaacagcaaaaattgagatcacagcacccagacaagggtccttagaggccccacagggagctactggctatgtcccagaagactcaagaagaaaaaaggcggggagttacaagaacctagaaactcaggggtggccaggatgtctgtggcacacccctgaagggcagagaagagaacagctaaggtttgctttgcagtttgaggaagcagcccaagaaaggtaaggaaaggaaaagcagaccaaatcaagaggcagcagaaaatcctgggacagaaggagagggaaagagttgtcaattgctacaacaaaagtaccttagaaaaaaaagagctgggccaggcacagtggctcacgcctgtaatcccagcactttgggaggctgaggcagcaggattacctgaggtcaggacttcgagaccagcctggccaacatggtaaaacaccatctctactaaaaatgcaaaaattagccaggtgtggtgacacgcacctgtaatcccagctactcgggaggctgaggcaggagaatcatttgaacccaggaggcggaggttgcagtgagcagagagcgtgccactgtactccagcctgggtgacagagcaagactccatctcaaaaaaaaagaaaagaaagagttgtcaattgataggaaaggggagaaggggctaaaagaaaataagacatagcagttttgaatctccctgttccttttttttttttttttcaatctccctgttcctaaaaagtacccacagaaagaaaagttatacctgtagccaagtagagcttatgggaaagagtatgtgctctgcgagaatcacttgaacccgggaggcggaggttgcagtgagccgagatcgcgccactgcacttcagcctgggctacagagtgagaccctgtctcaaaagaaaaaaaaagtgtgtggccaggcacggtggctcacgcctgtaattccagcactttcggaggccgaggcgggcggatcacgaggtcaggagatcaagaccatcctggctaacacggtgaaaccccatctctactaaaaatacaaaaaaattagccgggcgtggttgcgggggcgcctgtagtcccagctactcaagagtctgaggcagaagaatggcgtgaacccagggggcggagcttgcagtgagccgagatcgcgccactgcactccagcctgggtgactgagctagactccgtctcaaaaaaaaaaaaaaagtgtgtgttctggagtcagcttgacctggttcaaatcccagctctatcacttactgactatgtgactcttagataagtcctttcacctttctttgcctctgtttgctcatctgtgatatgaggataaagcaacacttacctcaaaaagttcttttaaggattaaatgacagtgcatgtgcaggggcctggcatataacaggtactcagtaaatttttttttaataaaaatgctacaatgttgaggtggtcttattattattattattattattattattattattattttctgagacaggctggagtgcagttggcgcaattgaagctcactgcagcctcgacctcttggactcaagagatctgcctgccacagcctcttaagtagctaggactatgggtgaatggcaccagccaccatgcctggataatttttgtgtttctttttttgtagagatggggtctcactatgttgcctatggctggtcttgaactcctagactcaagcgatactcctacctctgcctccttttaattttttttttaagagacgggggtctccatatgttgcctaagaataacctggccaggggccaggcgcggtggctcacgcctataatcccagcacttagggaggctgaggcaggtggatcacgaggtcaggagatcgagaccatcctggctaacgtggtgaaaccccgtctctactaaaaatacaaaaaaaaattagccaggcgtggtggcgggcgcctgtagtcccagctactcgggaggctgaggcaggagaatggcgtgaacctgggaggcggagcttgcagtgagctgagatcgcgccactgcagtccagcctgggcgacagagcgagactccctctcaaaaaaaaaaaaaaaaaaaaaagaataacctggccaggttattcttttattattattattatttcttttattcttttttttttttaagaggcagagtctcgttctgtcgcccagcctggagtgcagtggtgggatctcagctcactacaacatctgcctcccgggttcaagcgattctcctgcctcagcctcctgagtagctggaactacaggcatgcgccaccacgcccagctaattgttgtatttttagtagagacatggtttcaccacgttggtcaggctggtctcgaactcctgacctcaggtaatccaccagcctctgcctcccaaagtgctgggattacaggcgtgagccactgtgcctggccttttttttttttttttttttttgagacagccggctaatttgagacacctggctaattttttgtatatttagtagagacggggtttcaccatgttagccaggatggtctcgatctcctgacctcgtgatccacctgcctctgcctcccaaagtgctgggattacaggcgtgagccactgtgcccggcctttttttttttttttaaatataatagagacgagggtcatgctatgttgcccatgatggtctcaaactcctgggctcaagcaatccacccacctcagcctcccaaagtgctgggattcgaggcgtgagccactgcgcctggcctaggttttgtttgtttgtttgtttgtttgtttgtttgtttgttcgtcttttccgagacggagtctcactctttcccccaggctggagtgcagtgacgggatctccactcactgcaacctctgcctcctgggttctaacaattctcctgcctcagcctcctgagtagctgggattacgggtgcccgccaccacacccagctaatttttgtatttttagtacagacggggtttcaccatgttggtcaggctggacttgaacccctcagtgatctgcccgcctaagcctcccaaagtgctgggattgcaggcgtgagcccctgcacccagccggttattcttaataattctctggccacctgttctagagtgtaacacatctcaccacctgaagcatttcttttctttctttgtttctttcctttttttttttttttttttttttttgagacagagtctcgctctgtcaccaggctggagtgcagtggcgcaatctcggctcactgcaatctccgcctcctgggttcaagcaattctcctgcctcagcctcccaagtagctgggattacaggtgcatgccactacacccagctaatttttgtaattttagtagagacgaggtttcaccatgttggcctcgatctgctgacctcgtgatccgcccgccttggcctcccaaagtgttgggattacaggcgtgagccaccttgcccagcccctgaagcatttctttatggctaactgtggtgcctagtgcagcagctttgcatatagaatcccaggcttgggagaaagggcacccatagccctgcttccccatgctggttggcacatgacatgaactcactaaggctttttatttatttatttatttatttatttatttatttatttatttagctaaatgaagaaaccttgttctgagaagtaacctatgtcctgtggactgtccttctttccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatg

SEQ ID NO: 3467 - DNA, 10304 bp, human
tggtggcatagggcagacacgcctgcagacattctctgggaaagggcagcagcagccaggtgtggcagtgacagggaggtgaggagactgggggctgagggaggtgggccagggagggctgatgtggcacagtgggccggaaataggggccgggtcttgccttctactgacctccgccttcagccacttaggtcccttccatgcttccctctgaagctggggtgaggcccctcctgccaggtgccagacttgcttagcctctctctgcagcctctttccaggttcaacattgcttttcctctcactttttttcctctggccaaagattccccttattcccatagggccagattctcaggaagacttgagggaccccctaggtgcaaggtggccaagtttgtctctctgagacatttcctgccacacagggttagggtttagtgggaatgttgggcactgccaggtgctgttttccttccttgattacaaggcaagccaggcatgcacccaacacggggctgcgagtggatgaataaagcgtgctcagcgggctgcagagggctagccaacagggccaaggatttgggagcgtgtgtttccactttcttgaaggaggcagactgactcaagctgaacttggagtaattgatggttcggagattttttttttttttttgagacggactttcactcttgttgccctggctggggtgcaatggcgcaatctcggctcactgcaacctctgcctcccgggttcaagcgattctcctgcctcagcctcccgagtagctgggattacaggcatgcaccaccatgcctggctaattttgtatttttagtagagacggggtttctccatgttggtcaggctggtctcaaactcccaacctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgacatagggatcagttctccttccaaaggtaacagcaaaaattgagatcacagcacccagacaagggtccttagaggccccacagggagctactggctatgtcccagaagactcaagaagaaaaaaggcggggagttacaagaacctagaaactcaggggtggccaggatgtctgtggcacacccctgaagggcagagaagagaacagctaaggtttgctttgcagtttgaggaagcagcccaagaaaggtaaggaaaggaaaagcagaccaaatcaagaggcagcagaaaatcctgggacagaaggagagggaaagagttgtcaattgctacaacaaaagtaccttagaaaaaaaagagctgggccaggcacagtggctcacgcctgtaatcccagcactttgggaggctgaggcagcaggattacctgaggtcaggacttcgagaccagcctggccaacatggtaaaacaccatctctactaaaaatgcaaaaattagccaggtgtggtgacacgcacctgtaatcccagctactcgggaggctgaggcaggagaatcatttgaacccaggaggcggaggttgcagtgagcagagagcgtgccactgtactccagcctgggtgacagagcaagactccatctcaaaaaaaaagaaaagaaagagttgtcaattgataggaaaggggagaaggggctaaaagaaaataagacatagcagttttgaatctccctgttccttttttttttttttttcaatctccctgttcctaaaaagtacccacagaaagaaaagttatacctgtagccaagtagagcttatgggaaagagtatgtgctctgcgagaatcacttgaacccgggaggcggaggttgcagtgagccgagatcgcgccactgcacttcagcctgggctacagagtgagaccctgtctcaaaagaaaaaaaaagtgtgtggccaggcacggtggctcacgcctgtaattccagcactttcggaggccgaggcgggcggatcacgaggtcaggagatcaagaccatcctggctaacacggtgaaaccccatctctactaaaaatacaaaaaaattagccgggcgtggttgcgggggcgcctgtagtcccagctactcaagagtctgaggcagaagaatggcgtgaacccagggggcggagcttgcagtgagccgagatcgcgccactgcactccagcctgggtgactgagctagactccgtctcaaaaaaaaaaaaaaagtgtgtgttctggagtcagcttgacctggttcaaatcccagctctatcacttactgactatgtgactcttagataagtcctttcacctttctttgcctctgtttgctcatctgtgatatgaggataaagcaacacttacctcaaaaagttcttttaaggattaaatgacagtgcatgtgcaggggcctggcatataacaggtactcagtaaatttttttttaataaaaatgctacaatgttgaggtggtcttattattattattattattattattattattattattttctgagacaggctggagtgcagttggcgcaattgaagctcactgcagcctcgacctcttggactcaagagatctgcctgccacagcctcttaagtagctaggactatgggtgaatggcaccagccaccatgcctggataatttttgtgtttctttttttgtagagatggggtctcactatgttgcctatggctggtcttgaactcctagactcaagcgatactcctacctctgcctccttttaattttttttttaagagacgggggtctccatatgttgcctaagaataacctggccaggggccaggcgcggtggctcacgcctataatcccagcacttagggaggctgaggcaggtggatcacgaggtcaggagatcgagaccatcctggctaacgtggtgaaaccccgtctctactaaaaatacaaaaaaaaattagccaggcgtggtggcgggcgcctgtagtcccagctactcgggaggctgaggcaggagaatggcgtgaacctgggaggcggagcttgcagtgagctgagatcgcgccactgcagtccagcctgggcgacagagcgagactccctctcaaaaaaaaaaaaaaaaaaaaaagaataacctggccaggttattcttttattattattattatttcttttattcttttttttttttaagaggcagagtctcgttctgtcgcccagcctggagtgcagtggtgggatctcagctcactacaacatctgcctcccgggttcaagcgattctcctgcctcagcctcctgagtagctggaactacaggcatgcgccaccacgcccagctaattgttgtatttttagtagagacatggtttcaccacgttggtcaggctggtctcgaactcctgacctcaggtaatccaccagcctctgcctcccaaagtgctgggattacaggcgtgagccactgtgcctggccttttttttttttttttttttttgagacagccggctaatttgagacacctggctaattttttgtatatttagtagagacggggtttcaccatgttagccaggatggtctcgatctcctgacctcgtgatccacctgcctctgcctcccaaagtgctgggattacaggcgtgagccactgtgcccggcctttttttttttttttaaatataatagagacgagggtcatgctatgttgcccatgatggtctcaaactcctgggctcaagcaatccacccacctcagcctcccaaagtgctgggattcgaggcgtgagccactgcgcctggcctaggttttgtttgtttgtttgtttgtttgtttgtttgtttgttcgtcttttccgagacggagtctcactctttcccccaggctggagtgcagtgacgggatctccactcactgcaacctctgcctcctgggttctaacaattctcctgcctcagcctcctgagtagctgggattacgggtgcccgccaccacacccagctaatttttgtatttttagtacagacggggtttcaccatgttggtcaggctggacttgaacccctcagtgatctgcccgcctaagcctcccaaagtgctgggattgcaggcgtgagcccctgcacccagccggttattcttaataattctctggccacctgttctagagtgtaacacatctcaccacctgaagcatttcttttctttctttgtttctttcctttttttttttttttttttttttttgagacagagtctcgctctgtcaccaggctggagtgcagtggcgcaatctcggctcactgcaatctccgcctcctgggttcaagcaattctcctgcctcagcctcccaagtagctgggattacaggtgcatgccactacacccagctaatttttgtaattttagtagagacgaggtttcaccatgttggcctcgatctgctgacctcgtgatccgcccgccttggcctcccaaagtgttgggattacaggcgtgagccaccttgcccagcccctgaagcatttctttatggctaactgtggtgcctagtgcagcagctttgcatatagaatcccaggcttgggagaaagggcacccatagccctgcttccccatgctggttggcacatgacatgaactcactaaggctttttatttatttatttatttatttatttatttatttatttatttagctaaatgaagaaaccttgttctgagaagtaacctatgtcctgtggactgtccttctttccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaa

SEQ ID NO: 3468 - DNA, 5371 bp, human
gggaaccatttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggtaggttgcctaattatctggagaatcagggctgggagagggtggtggtaaggaggggtggctatgtgctttgggaagtagtggggaggaggagggtggagagataagtgtagggatgtgtgtggggaaggacttggggtttacgagggaggagtggggtggtgtgtagaggaagattaaggaaagtaggggtgggcacaggctgtgggggaggaatggggtaaggtttcagggagcgtaggttgggaggagtgaatttggtgggaagggttccctttttcctaccccagtgggcttttggtgccagagtccttccttcaggatttgggggagtacaccaggcttcttggttctaagacctttacagctttttggttctagatgggagtgggatttctgggtttgatgaatggtaactaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaagtggcatgcggcagggcatggatcttctagctcctgccgtcctgctccatgaagcgcatgaagtgcctgtctctgctatgggttggcatgggaaccaggggcagtgggggaaattgaaaacaagagcagtgagaatggcgagtttcctgtttcagctatgccatctctgtctccgaatcttctcatttagagcctctccctttccctccctgggaggttacagagtaaccaagggagagagacaccaaggtcttaagatactgatgtaacaagggccagggtgtaaaggccggaacaacagggatcccaggagagggactgaactgttggtcaggggatggttggagacctggtttggtggcctttctcatgtccatccccccactttctcagttccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaagtgcgtgagggtcttgggggctatgcagagggcagggatctgggcaggagtatgagtaagacagagactgttggtaagaacctagcaggatggagctgggcgagagagtgatgtagggagagagtcagagtatttggctctgtggtcattgatcctggaggaggggcggaagctgaggaaatgagagggtggtcttgagtgaatattcaaacctgttcccacctctagggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtgaggacactcagtgggggctgatttacagagcctggccagccctgacctgcccctcccatcctggggctgcagggtccaggccctgtggaaaggggagtggggaggaaaggcggccatcatgagggagcgtattcaaggacagagcttctccaggatgtgcacagctggccttccttacctcccaggacctcaccatcaagtcggcagcctgcggcgcaggttggggggtccctgggcccactgtctgctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaa

SEQ ID NO: 3469 - DNA, 15434 bp, human
tccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggtaggttgcctaattatctggagaatcagggctgggagagggtggtggtaaggaggggtggctatgtgctttgggaagtagtggggaggaggagggtggagagataagtgtagggatgtgtgtggggaaggacttggggtttacgagggaggagtggggtggtgtgtagaggaagattaaggaaagtaggggtgggcacaggctgtgggggaggaatggggtaaggtttcagggagcgtaggttgggaggagtgaatttggtgggaagggttccctttttcctaccccagtgggcttttggtgccagagtccttccttcaggatttgggggagtacaccaggcttcttggttctaagacctttacagctttttggttctagatgggagtgggatttctgggtttgatgaatggtaactaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaagtggcatgcggcagggcatggatcttctagctcctgccgtcctgctccatgaagcgcatgaagtgcctgtctctgctatgggttggcatgggaaccaggggcagtgggggaaattgaaaacaagagcagtgagaatggcgagtttcctgtttcagctatgccatctctgtctccgaatcttctcatttagagcctctccctttccctccctgggaggttacagagtaaccaagggagagagacaccaaggtcttaagatactgatgtaacaagggccagggtgtaaaggccggaacaacagggatcccaggagagggactgaactgttggtcaggggatggttggagacctggtttggtggcctttctcatgtccatccccccactttctcagttccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaagtgcgtgagggtcttgggggctatgcagagggcagggatctgggcaggagtatgagtaagacagagactgttggtaagaacctagcaggatggagctgggcgagagagtgatgtagggagagagtcagagtatttggctctgtggtcattgatcctggaggaggggcggaagctgaggaaatgagagggtggtcttgagtgaatattcaaacctgttcccacctctagggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtgaggacactcagtgggggctgatttacagagcctggccagccctgacctgcccctcccatcctggggctgcagggtccaggccctgtggaaaggggagtggggaggaaaggcggccatcatgagggagcgtattcaaggacagagcttctccaggatgtgcacagctggccttccttacctcccaggacctcaccatcaagtcggcagcctgcggcgcaggttggggggtccctgggcccactgtctgctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagcaaagaacaagcctgactccccttccccaccgctgcacacatcttgcccctcccttacttgtcttccttccctccagcgcacaagccctgaggggggcattcacctgagctgtcactactgtcacagcctcttcagtggcaagcctgaggtcttggactggcaggtaagagccccacccccacccacgtcttgccacacgaccagactgtctgaaggggtccttccacttggcccctgctggggccagatgttacagcttgtcctccctgccctgtgcccccacctcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggtaaggagatggggaagggcagaagacactataactcccagccagggagaatggaggagaagggagggaggccgggaaagtggtccatgaggcagggccttctgcccgggatgttctacccccatctcccctaaagttttgggcacaaggggctgcttagagagaggtttcaggtatagcaccttgaaaaggttgggtctcttgcccttgggtatctgtgtctctggactctctttcctcttctcctctttccaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaactccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagcattcatttgttttgatctacaggtcagtctcctgagtcaaaaccccagacaccctctcaaaccaaagtggagaacagcaacacagtgaggaccccagaggaaaatgggaatttgggcaaggtcggggcaaaagccaagggggaggataatctcagaggagggtacggcggttggtggcacaaatgttcctctgtctttgcagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacaggtgagccagggtacctcgatgccacaggctgtattccagagtcctaggcctgccagccctatgtccgtgagctggacaaggggatttcttaggtagctgaagcctcattcatatggttgtcctagaatcatagaggtgtctttcagcctttgattcaagggcagttttgtgacactgagcatgttagagcttttggtgggtcagatgtgaccagtccagcagggtctctgagaagacccctttcttatccacagaagagtggaagccacaggtgatcgtgctgcccatcccagtgcccatcttcgtgccagtgcctatgcatctgtactgccagaaagtcccggtgcctttctcgatgcctatcccggtgagtttccctgcccttcctggctgggtcctcctttccccttactctcatcaactgtcccccttcactcatcatctgtccccccaacttccccccaactgctggtgtggttcttggcatttagttgggattcgtgcctccaggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtggtatgccatagatggtggcgacgagggagacagggtgctaccagcatgtctctgcccgagggggtggtattggtgatcttggtgcctagtagaatgggaggatagttgggatcagtccctgaaagcttgtgagggtgctagcaggagcttgtaaccactgagccaacttctctgcttcccagatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagagtgagtaagattggagccatgcccactgagtatggtagcatttgtgccatcaggaagggagtgtcccttgtgtccctgagcatgaccctgaaaagtgttcattgtgattctaagacggaaggttctcacagggagcagtgccagagacaccaggacaggtgcactcttttagacttctgagtcatgcttttttttttttttttttttttttaatttttaagctgaaaaaaaacataaaattttaccatgttcaacatgtttacggttcagtagttcacattgctgtgttttgcgtttctgtgcctctgagcatgctttttggtatagctttactggttcctttggctcatctagtgtcaagtgggcaagtagcaggggtggggcaggagggctgcagggttgagatcttaagaaattgatttcttctttctttccttttcattagatcctctggacattaatcccagtgtagacttcctctttgattgtggcctggtagggcctgaggatgtgtctactgaacaagaccttccccgaaccatgaggaaggtagggctggggctactgtatgtacaaaagaagaatggaggcccaaaggggagatgatgcgagagccaagccagcaaccatagtttgaccttccctaacctcctttctccaacactagaagtactgagataaagccaaactttgctctccccccatctcacaaggtcatcaaagctgttcctggggctctgtgctatggaagcttgctgtgtgcttacatcagcccctgccccggccagcagtaaatatggtgctgactagctttcaccttgcctctggccttacctctgccatgcccctgctttctcttcccctccagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccgtaagtacttggggatggggggtgtggggaggcagggacagggaggaggaggggaaaggggagaaggggctgggcctgtgattcagctgaagatgtctagaagtgataagggtgtgatcccttaaggatgccctgtgaagatggggaggagttgtagattaaagggaaatgctgtctaggttccaggttaggggctctttctgtaattgttcaggagctaggcatgactaagggatggaggggttaatggtgatggagctaagtgaaattctccatgtagagtttttcttaatcctgtccctgcacaacatatcactgcagccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctacccaaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgcagagctgtgggtatacctgggggaaagcactcgaggccacctaatcaagcaactgtttcccatcgtctcctaatgatcaaggacaccatacctgggggcttcagcatcattatctttcttctaggacctacagtctagccttaggtgtgtctgtttttctttccccagtacttgctggaaaataaccggatggtgaacattttcacggacctttactacctgacttttgttcaagaactcaacaagtctctgagtacctggcagcccacactcctccccaacagtaaggaacagggacgtagcaacccctacccgctttctccattcttccaatccaccatcccgagagtcctgtgctgtttggtctgccactcttcacaaagggcccgagggcaggagcgtgtagctggatgcctcagggtttagagttaaaggagcacaggagcgcctgttcttgaacgtgagatggggatcaagacttaggtctgaagagctatctctaggaccagaaaaagatggcctgggtttgggtggtaagtaaagaaagaaagcaagaaatcgtgggactcctcaaggtttacatttacttgtctacaacttgagggtggtgagaggcgttccaaatgcaggtgtggaaagtatatattttttaaagcccagtcccactgtgtagtgtagcaagtgtagcgaagtgacagtgttttatatacaaaggttactcaccaaatgagaattgtgtgggaaatgagcagggcacatgggatgggaagtggttgggtttgggtagccactccctcctgactggcctctcccccttgaccattgtagatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgaggtacgaggctgccccctcccctgtgcttttgccccttctctgccttccccttccatgccctgccataacccaccatacctgccaggtcggccctctccttggcgcctagcttccctctcctgttcctgtgtgcagaaagggtagaaacagccagtcctcctacctgataggcagtagctgttgcataaataagaggtcaccctctggcctgtttcccctctttcctcatttaagacagtttacttgcttgcctgctttttctgggtggtggacaggtaggaaaccattgggtgtgtttggctgtcggggagggtagaatgacaggctttctgtgattctttgctatcgggtctaacaacaactgcaccttggtttccattttttctgtccctggacttctgtcctgtctgagtgaagtttccaaggtcctttctctggacccatgcttctacctggactaatgcacaaggggttggggtcattgctgtttctctatcccagaaggcaagcccacccttgcagtagggtctgttttatcaggtcttttgaataacttctgagatcacctcttcaagatagcaacttgggggagattttaaagagagtctttggcagtgggaactggggagggttgcataacaacagcccgacaggatgttgggttggcgtgggagagggagactgacctcttcttccacctctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaatt

SEQ ID NO: 3470 - DNA, 15522 bp, human
gagagagagagagagagagagagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggtaggttgcctaattatctggagaatcagggctgggagagggtggtggtaaggaggggtggctatgtgctttgggaagtagtggggaggaggagggtggagagataagtgtagggatgtgtgtggggaaggacttggggtttacgagggaggagtggggtggtgtgtagaggaagattaaggaaagtaggggtgggcacaggctgtgggggaggaatggggtaaggtttcagggagcgtaggttgggaggagtgaatttggtgggaagggttccctttttcctaccccagtgggcttttggtgccagagtccttccttcaggatttgggggagtacaccaggcttcttggttctaagacctttacagctttttggttctagatgggagtgggatttctgggtttgatgaatggtaactaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaagtggcatgcggcagggcatggatcttctagctcctgccgtcctgctccatgaagcgcatgaagtgcctgtctctgctatgggttggcatgggaaccaggggcagtgggggaaattgaaaacaagagcagtgagaatggcgagtttcctgtttcagctatgccatctctgtctccgaatcttctcatttagagcctctccctttccctccctgggaggttacagagtaaccaagggagagagacaccaaggtcttaagatactgatgtaacaagggccagggtgtaaaggccggaacaacagggatcccaggagagggactgaactgttggtcaggggatggttggagacctggtttggtggcctttctcatgtccatccccccactttctcagttccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaagtgcgtgagggtcttgggggctatgcagagggcagggatctgggcaggagtatgagtaagacagagactgttggtaagaacctagcaggatggagctgggcgagagagtgatgtagggagagagtcagagtatttggctctgtggtcattgatcctggaggaggggcggaagctgaggaaatgagagggtggtcttgagtgaatattcaaacctgttcccacctctagggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtgaggacactcagtgggggctgatttacagagcctggccagccctgacctgcccctcccatcctggggctgcagggtccaggccctgtggaaaggggagtggggaggaaaggcggccatcatgagggagcgtattcaaggacagagcttctccaggatgtgcacagctggccttccttacctcccaggacctcaccatcaagtcggcagcctgcggcgcaggttggggggtccctgggcccactgtctgctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagcaaagaacaagcctgactccccttccccaccgctgcacacatcttgcccctcccttacttgtcttccttccctccagcgcacaagccctgaggggggcattcacctgagctgtcactactgtcacagcctcttcagtggcaagcctgaggtcttggactggcaggtaagagccccacccccacccacgtcttgccacacgaccagactgtctgaaggggtccttccacttggcccctgctggggccagatgttacagcttgtcctccctgccctgtgcccccacctcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggtaaggagatggggaagggcagaagacactataactcccagccagggagaatggaggagaagggagggaggccgggaaagtggtccatgaggcagggccttctgcccgggatgttctacccccatctcccctaaagttttgggcacaaggggctgcttagagagaggtttcaggtatagcaccttgaaaaggttgggtctcttgcccttgggtatctgtgtctctggactctctttcctcttctcctctttccaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaactccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagcattcatttgttttgatctacaggtcagtctcctgagtcaaaaccccagacaccctctcaaaccaaagtggagaacagcaacacagtgaggaccccagaggaaaatgggaatttgggcaaggtcggggcaaaagccaagggggaggataatctcagaggagggtacggcggttggtggcacaaatgttcctctgtctttgcagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacaggtgagccagggtacctcgatgccacaggctgtattccagagtcctaggcctgccagccctatgtccgtgagctggacaaggggatttcttaggtagctgaagcctcattcatatggttgtcctagaatcatagaggtgtctttcagcctttgattcaagggcagttttgtgacactgagcatgttagagcttttggtgggtcagatgtgaccagtccagcagggtctctgagaagacccctttcttatccacagaagagtggaagccacaggtgatcgtgctgcccatcccagtgcccatcttcgtgccagtgcctatgcatctgtactgccagaaagtcccggtgcctttctcgatgcctatcccggtgagtttccctgcccttcctggctgggtcctcctttccccttactctcatcaactgtcccccttcactcatcatctgtccccccaacttccccccaactgctggtgtggttcttggcatttagttgggattcgtgcctccaggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtggtatgccatagatggtggcgacgagggagacagggtgctaccagcatgtctctgcccgagggggtggtattggtgatcttggtgcctagtagaatgggaggatagttgggatcagtccctgaaagcttgtgagggtgctagcaggagcttgtaaccactgagccaacttctctgcttcccagatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagagtgagtaagattggagccatgcccactgagtatggtagcatttgtgccatcaggaagggagtgtcccttgtgtccctgagcatgaccctgaaaagtgttcattgtgattctaagacggaaggttctcacagggagcagtgccagagacaccaggacaggtgcactcttttagacttctgagtcatgcttttttttttttttttttttttttaatttttaagctgaaaaaaaacataaaattttaccatgttcaacatgtttacggttcagtagttcacattgctgtgttttgcgtttctgtgcctctgagcatgctttttggtatagctttactggttcctttggctcatctagtgtcaagtgggcaagtagcaggggtggggcaggagggctgcagggttgagatcttaagaaattgatttcttctttctttccttttcattagatcctctggacattaatcccagtgtagacttcctctttgattgtggcctggtagggcctgaggatgtgtctactgaacaagaccttccccgaaccatgaggaaggtagggctggggctactgtatgtacaaaagaagaatggaggcccaaaggggagatgatgcgagagccaagccagcaaccatagtttgaccttccctaacctcctttctccaacactagaagtactgagataaagccaaactttgctctccccccatctcacaaggtcatcaaagctgttcctggggctctgtgctatggaagcttgctgtgtgcttacatcagcccctgccccggccagcagtaaatatggtgctgactagctttcaccttgcctctggccttacctctgccatgcccctgctttctcttcccctccagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccgtaagtacttggggatggggggtgtggggaggcagggacagggaggaggaggggaaaggggagaaggggctgggcctgtgattcagctgaagatgtctagaagtgataagggtgtgatcccttaaggatgccctgtgaagatggggaggagttgtagattaaagggaaatgctgtctaggttccaggttaggggctctttctgtaattgttcaggagctaggcatgactaagggatggaggggttaatggtgatggagctaagtgaaattctccatgtagagtttttcttaatcctgtccctgcacaacatatcactgcagccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctacccaaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgcagagctgtgggtatacctgggggaaagcactcgaggccacctaatcaagcaactgtttcccatcgtctcctaatgatcaaggacaccatacctgggggcttcagcatcattatctttcttctaggacctacagtctagccttaggtgtgtctgtttttctttccccagtacttgctggaaaataaccggatggtgaacattttcacggacctttactacctgacttttgttcaagaactcaacaagtctctgagtacctggcagcccacactcctccccaacagtaaggaacagggacgtagcaacccctacccgctttctccattcttccaatccaccatcccgagagtcctgtgctgtttggtctgccactcttcacaaagggcccgagggcaggagcgtgtagctggatgcctcagggtttagagttaaaggagcacaggagcgcctgttcttgaacgtgagatggggatcaagacttaggtctgaagagctatctctaggaccagaaaaagatggcctgggtttgggtggtaagtaaagaaagaaagcaagaaatcgtgggactcctcaaggtttacatttacttgtctacaacttgagggtggtgagaggcgttccaaatgcaggtgtggaaagtatatattttttaaagcccagtcccactgtgtagtgtagcaagtgtagcgaagtgacagtgttttatatacaaaggttactcaccaaatgagaattgtgtgggaaatgagcagggcacatgggatgggaagtggttgggtttgggtagccactccctcctgactggcctctcccccttgaccattgtagatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgaggtacgaggctgccccctcccctgtgcttttgccccttctctgccttccccttccatgccctgccataacccaccatacctgccaggtcggccctctccttggcgcctagcttccctctcctgttcctgtgtgcagaaagggtagaaacagccagtcctcctacctgataggcagtagctgttgcataaataagaggtcaccctctggcctgtttcccctctttcctcatttaagacagtttacttgcttgcctgctttttctgggtggtggacaggtaggaaaccattgggtgtgtttggctgtcggggagggtagaatgacaggctttctgtgattctttgctatcgggtctaacaacaactgcaccttggtttccattttttctgtccctggacttctgtcctgtctgagtgaagtttccaaggtcctttctctggacccatgcttctacctggactaatgcacaaggggttggggtcattgctgtttctctatcccagaaggcaagcccacccttgcagtagggtctgttttatcaggtcttttgaataacttctgagatcacctcttcaagatagcaacttgggggagattttaaagagagtctttggcagtgggaactggggagggttgcataacaacagcccgacaggatgttgggttggcgtgggagagggagactgacctcttcttccacctctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgt

SEQ ID NO: 3471 - DNA, 15025 bp, human
attgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggtaggttgcctaattatctggagaatcagggctgggagagggtggtggtaaggaggggtggctatgtgctttgggaagtagtggggaggaggagggtggagagataagtgtagggatgtgtgtggggaaggacttggggtttacgagggaggagtggggtggtgtgtagaggaagattaaggaaagtaggggtgggcacaggctgtgggggaggaatggggtaaggtttcagggagcgtaggttgggaggagtgaatttggtgggaagggttccctttttcctaccccagtgggcttttggtgccagagtccttccttcaggatttgggggagtacaccaggcttcttggttctaagacctttacagctttttggttctagatgggagtgggatttctgggtttgatgaatggtaactaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaagtggcatgcggcagggcatggatcttctagctcctgccgtcctgctccatgaagcgcatgaagtgcctgtctctgctatgggttggcatgggaaccaggggcagtgggggaaattgaaaacaagagcagtgagaatggcgagtttcctgtttcagctatgccatctctgtctccgaatcttctcatttagagcctctccctttccctccctgggaggttacagagtaaccaagggagagagacaccaaggtcttaagatactgatgtaacaagggccagggtgtaaaggccggaacaacagggatcccaggagagggactgaactgttggtcaggggatggttggagacctggtttggtggcctttctcatgtccatccccccactttctcagttccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaagtgcgtgagggtcttgggggctatgcagagggcagggatctgggcaggagtatgagtaagacagagactgttggtaagaacctagcaggatggagctgggcgagagagtgatgtagggagagagtcagagtatttggctctgtggtcattgatcctggaggaggggcggaagctgaggaaatgagagggtggtcttgagtgaatattcaaacctgttcccacctctagggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtgaggacactcagtgggggctgatttacagagcctggccagccctgacctgcccctcccatcctggggctgcagggtccaggccctgtggaaaggggagtggggaggaaaggcggccatcatgagggagcgtattcaaggacagagcttctccaggatgtgcacagctggccttccttacctcccaggacctcaccatcaagtcggcagcctgcggcgcaggttggggggtccctgggcccactgtctgctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagcaaagaacaagcctgactccccttccccaccgctgcacacatcttgcccctcccttacttgtcttccttccctccagcgcacaagccctgaggggggcattcacctgagctgtcactactgtcacagcctcttcagtggcaagcctgaggtcttggactggcaggtaagagccccacccccacccacgtcttgccacacgaccagactgtctgaaggggtccttccacttggcccctgctggggccagatgttacagcttgtcctccctgccctgtgcccccacctcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggtaaggagatggggaagggcagaagacactataactcccagccagggagaatggaggagaagggagggaggccgggaaagtggtccatgaggcagggccttctgcccgggatgttctacccccatctcccctaaagttttgggcacaaggggctgcttagagagaggtttcaggtatagcaccttgaaaaggttgggtctcttgcccttgggtatctgtgtctctggactctctttcctcttctcctctttccaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaactccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagcattcatttgttttgatctacaggtcagtctcctgagtcaaaaccccagacaccctctcaaaccaaagtggagaacagcaacacagtgaggaccccagaggaaaatgggaatttgggcaaggtcggggcaaaagccaagggggaggataatctcagaggagggtacggcggttggtggcacaaatgttcctctgtctttgcagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacaggtgagccagggtacctcgatgccacaggctgtattccagagtcctaggcctgccagccctatgtccgtgagctggacaaggggatttcttaggtagctgaagcctcattcatatggttgtcctagaatcatagaggtgtctttcagcctttgattcaagggcagttttgtgacactgagcatgttagagcttttggtgggtcagatgtgaccagtccagcagggtctctgagaagacccctttcttatccacagaagagtggaagccacaggtgatcgtgctgcccatcccagtgcccatcttcgtgccagtgcctatgcatctgtactgccagaaagtcccggtgcctttctcgatgcctatcccggtgagtttccctgcccttcctggctgggtcctcctttccccttactctcatcaactgtcccccttcactcatcatctgtccccccaacttccccccaactgctggtgtggttcttggcatttagttgggattcgtgcctccaggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtggtatgccatagatggtggcgacgagggagacagggtgctaccagcatgtctctgcccgagggggtggtattggtgatcttggtgcctagtagaatgggaggatagttgggatcagtccctgaaagcttgtgagggtgctagcaggagcttgtaaccactgagccaacttctctgcttcccagatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagagtgagtaagattggagccatgcccactgagtatggtagcatttgtgccatcaggaagggagtgtcccttgtgtccctgagcatgaccctgaaaagtgttcattgtgattctaagacggaaggttctcacagggagcagtgccagagacaccaggacaggtgcactcttttagacttctgagtcatgcttttttttttttttttttttttttaatttttaagctgaaaaaaaacataaaattttaccatgttcaacatgtttacggttcagtagttcacattgctgtgttttgcgtttctgtgcctctgagcatgctttttggtatagctttactggttcctttggctcatctagtgtcaagtgggcaagtagcaggggtggggcaggagggctgcagggttgagatcttaagaaattgatttcttctttctttccttttcattagatcctctggacattaatcccagtgtagacttcctctttgattgtggcctggtagggcctgaggatgtgtctactgaacaagaccttccccgaaccatgaggaaggtagggctggggctactgtatgtacaaaagaagaatggaggcccaaaggggagatgatgcgagagccaagccagcaaccatagtttgaccttccctaacctcctttctccaacactagaagtactgagataaagccaaactttgctctccccccatctcacaaggtcatcaaagctgttcctggggctctgtgctatggaagcttgctgtgtgcttacatcagcccctgccccggccagcagtaaatatggtgctgactagctttcaccttgcctctggccttacctctgccatgcccctgctttctcttcccctccagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccgtaagtacttggggatggggggtgtggggaggcagggacagggaggaggaggggaaaggggagaaggggctgggcctgtgattcagctgaagatgtctagaagtgataagggtgtgatcccttaaggatgccctgtgaagatggggaggagttgtagattaaagggaaatgctgtctaggttccaggttaggggctctttctgtaattgttcaggagctaggcatgactaagggatggaggggttaatggtgatggagctaagtgaaattctccatgtagagtttttcttaatcctgtccctgcacaacatatcactgcagccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctacccaaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgcagagctgtgggtatacctgggggaaagcactcgaggccacctaatcaagcaactgtttcccatcgtctcctaatgatcaaggacaccatacctgggggcttcagcatcattatctttcttctaggacctacagtctagccttaggtgtgtctgtttttctttccccagtacttgctggaaaataaccggatggtgaacattttcacggacctttactacctgacttttgttcaagaactcaacaagtctctgagtacctggcagcccacactcctccccaacagtaaggaacagggacgtagcaacccctacccgctttctccattcttccaatccaccatcccgagagtcctgtgctgtttggtctgccactcttcacaaagggcccgagggcaggagcgtgtagctggatgcctcagggtttagagttaaaggagcacaggagcgcctgttcttgaacgtgagatggggatcaagacttaggtctgaagagctatctctaggaccagaaaaagatggcctgggtttgggtggtaagtaaagaaagaaagcaagaaatcgtgggactcctcaaggtttacatttacttgtctacaacttgagggtggtgagaggcgttccaaatgcaggtgtggaaagtatatattttttaaagcccagtcccactgtgtagtgtagcaagtgtagcgaagtgacagtgttttatatacaaaggttactcaccaaatgagaattgtgtgggaaatgagcagggcacatgggatgggaagtggttgggtttgggtagccactccctcctgactggcctctcccccttgaccattgtagatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgaggtacgaggctgccccctcccctgtgcttttgccccttctctgccttccccttccatgccctgccataacccaccatacctgccaggtcggccctctccttggcgcctagcttccctctcctgttcctgtgtgcagaaagggtagaaacagccagtcctcctacctgataggcagtagctgttgcataaataagaggtcaccctctggcctgtttcccctctttcctcatttaagacagtttacttgcttgcctgctttttctgggtggtggacaggtaggaaaccattgggtgtgtttggctgtcggggagggtagaatgacaggctttctgtgattctttgctatcgggtctaacaacaactgcaccttggtttccattttttctgtccctggacttctgtcctgtctgagtgaagtttccaaggtcctttctctggacccatgcttctacctggactaatgcacaaggggttggggtcattgctgtttctctatcccagaaggcaagcccacccttgcagtagggtctgttttatcaggtcttttgaataacttctgagatcacctcttcaagatagcaacttgggggagattttaaagagagtctttggcagtgggaactggggagggttgcataacaacagcccgacaggatgttgggttggcgtgggagagggagactgacctcttcttccacctctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgt

SEQ ID NO: 3472 - DNA, 2758 bp, human
gagagactctcagccactcccccagggccggccacctcccagccattgcctggtgtgcggccgcaggggatgtccaagaaaccccaaaagcctaagcacagcagccctgggaagaaaccagcaggaaggaagaccagggagtcccaggctgtggcgagagaagataatgacccaaatagagatgaggtcccaagggcccaagtaagtaggcccttctcaccctcctctccctcttcatcctcctcctcctctggtctccccccagcctcctctcttccagcacacacctgtttacccatgccccctatgtcccttgctcaagggttgttatcggaaggccagggacactagaatgcccaatcagggtcttcgttgtaggggcacacgttaaagggagtacttggtgtgtgacgggcaaacctccggacactctgcaggggtcctacctcctcccccagagaggagctgggatggaaggcagggctggcagctggttaggttggggtgatcccttaaagtgtgggccgcaaacctggggcatctaggctcatcaacttcccgactcctccttacttagctgttgcccgagccacctggaaaggggcccaggctatctcactatccccagtgttttccctggctgggctctgcctcctggcctggggctgactgggggagaaagtgctaatgagattaggctctggagtctccatcttaccacaacccctcccatatgtactcactgcccgcccccaccgccagcccgactcagaaatttctgttttagcttcccacacaccggccaggactgcctcgcctatccacgcatcgtggagaattcagcagtagcgactccaacatcagagctccccaagttctggggacttcagagccctctgcctacagcctgggaggcctcgtgcccagacgccatgcaccctctggtgagtcttgcgggtttgataggagtggaggggagaggggtcgggagggaaacctctggctctgtcgcttctgggggctcagccttgttcccaggcttccctgcccacccaggcaggtatcccatgggaaatggggtgtcgacagggctggctttaagccacatcatcctctctgagtggggtttgtgtggtggggggcgatttggagcagcgctccaaactccaactctggaagactttcggcagtactgagcccttttctgttaagtcctgctcagccacactggccctccgagggcctggctgtggctgccccactgctggtgtccaacccggagtcacaacgctagggggccacaggtgcagatgggctcatactggggaacagggaagacagtcacagagggagggttggagatgctgggcagagcaggggcaacatgttgccagcagagggtgatggtgcctcactttagaccctgctaggccttttccacctcactgggcggcttggaagctggattttgtgttctctttcaggtgactggcagccacctgtccatcccccaagaccggaaaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactaggtatgagggagccctggctggggcagggatggacagcagtgtctttctgcaggtgccgggggcagggtggactgtaggtacaggcggcatcactgggactgactttcctttggggaagagaaccaagcaggcctggccctggagccttctgtgcctttccagctaggggtgtgcacagacagcaatgtgttgtctgaactccatgtacacttagtccacgagtcccagaactctcctcttacgacggttagagatacctcatgtgttttccctacaagcctggtagggcttgtatggtgtttgcttgctggctggcttatctgtctttgaaacacgttctgaaaggttctgggatgccccagcacctgagaaccactttcctgcttagaaggcatttctacatttaattcaggtgacgcgtggatgagtcagtcccagggctggtggggtttctggttgcagggctaggtggttccccaccggggcagggcgtgggtttctgtttccctgggtctggagtgcccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttcctctgcatttgcacacttcccaacgcagttcaaagcaatttgaaataaagtcgttctcatatt

SEQ ID NO: 3473 - DNA, 1273 bp, human
aggtgactggcagccacctgtccatcccccaagaccggaaaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactaggtatgagggagccctggctggggcagggatggacagcagtgtctttctgcaggtgccgggggcagggtggactgtaggtacaggcggcatcactgggactgactttcctttggggaagagaaccaagcaggcctggccctggagccttctgtgcctttccagctaggggtgtgcacagacagcaatgtgttgtctgaactccatgtacacttagtccacgagtcccagaactctcctcttacgacggttagagatacctcatgtgttttccctacaagcctggtagggcttgtatggtgtttgcttgctggctggcttatctgtctttgaaacacgttctgaaaggttctgggatgccccagcacctgagaaccactttcctgcttagaaggcatttctacatttaattcaggtgacgcgtggatgagtcagtcccagggctggtggggtttctggttgcagggctaggtggttccccaccggggcagggcgtgggtttctgtttccctgggtctggagtgcccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttcctctgcatttgcacacttcccaacgcagttcaaagcaatttgaaataaagtcgttctcat

SEQ ID NO: 3474 - DNA, 9259 bp, human
ttggcgttcactgcaagctataagctctgcaagtggtgaccccgacgtgatcgccttgaagttacgcgtgaaggaggagagctcattacttttcggggaatcctggtaagggacagtcctgactcccatcaggaggacgggacccatgcgtaaactatcgcgggttgggttatcatgggtcaggaaatgaccaaagaacagaaagtattttttaaaacagtgcaacagctacttaaggctatccagtgcactgtagagcctggagctctacacaagcttatgcttttaatttggcagaaatgcccttggtttcctgatcaaggaaccttagatttagggttatgagagcaggtaggtcgctgcctgaaaagaggatatgagcagggtcattttactaatgttactattttgaccacctgggcgctggtacgctctgcgttgtatcctctttatctgccagatcgtggttagatcgcccattatctccacctgaaaagaattcagaagatttgaagggagagattcctctccccacttcattccgttctatggggaataaggaagaggtttttttctagtgaggacaaacaggaaccagaacagtggttggggggtgggggtgctcctctctctacctcattcccttctgtagggcataaggaggatttttttttttttttttttttttagtgaggataaggacggacgggagccttttcctccccctgtagaaaagccattgcccttctttcctccacccttaaaaggacctgcatttgttggccctgttcagccaacagcgccttccatcccccttaaggagattggaggccgcccaagggacggctcttagataagacccccggtcagcgaacatctgtatgatctgtatgattgggtggctgcgtctcctcgactaacttccctgctggaggggtgcgtccaggagggaaggaaagtggctgattatgattgtcttcctaatatgcaagttcccatttgctacttccagcatcagcctttctggccttgtcttttttctgtttcactggagtaaaaggggaagttgcatgctgcctcctgggttttatcccagatagctctagctttcttgctgcccacagaggcctggggcaggagagttgctgagatgccatggagtgcacacttggtcactggcagcctgggcaggttgcccctttctgggtttgtggtgacggagggaaggccaaaaggcacagaccgagtccccgggtggctgcaggcagctccagcccagtcctgaggatccgcctcaccatggtcacgtgccttagtaactgtgcccaggaagtggcctgctgcttgccgtgctgctgcttttcctacttctgcccttccctgccactcctcacatgtctcagttgacgagcaattccttgtcttccctggccccctagggaaagggctgagaaatagtccatgtgcacccggaccttactagcctaaggtgggcaaaggagtgtggagcagcccggagtacagagccctggaggaggagcccactaataaggggcgctctcccatagccatatattaaatgctaactagactgagggggacgagctctgccagctgctgtcatcttcagaagatagacgcagcagtaaggagtgtttgttttgcttttttacaaaatgtttaaaaacactgtggttaagaaacttcaaagcagaccctgtgctgcatgtctgctcctcccctgagcctctctgcttgggggtggtaaaaataataaaaagcccagtatattttcagtacctcacctaacagggttggctgcaggcgtaggtggcctagaagataaggggagtgtttttctcccagcctgttaccttcttgcctccagcctccgcacttccacacacagtttaccacccggtcattctctggcctcttactgccgcttgtactcttccttccttcctctcagggtaaggacagcaacaagtggcaggctattaaaaagagaagctgcctaaggggcccagaacgaatagaaagaaactggccacagccctactttcccaagctcacttctaagacattccagctaaaggctgatgcaggaaaatggctaacaccaaaggacattttaaaaagcttttttttgttttcttttctttttaacacacttaagctaactcaatgcaggtttattatcctggcgacttgcagtcactttctaatggctttcaagggccaaaatatagtaaaaatcacttaaaatatccatcctttccatgccttagtttaacaggtaggctttatcttttgccatttcggtattttatatgttatgtacctgtctcataatccctctaaacttatacaaaagactacagatataatagcttctcttctcataaaaggacgccaacgttgcgtccagctgtcaggataagaccctgctactcttttcctacctttaagcaaggaacaatttcacactctcttagcttgtgatcttgattggcaagtagcaatggctgtctttattggtaatatcagctttcatttaccagcctctaagctcctgaactttttacaaactgtacctgtttaatttgtatgtattgttgtctctgagcctttacttcatgccaccactgtctttacagatggttaaaaaaaaacccaaaaactgaaaaagcagctatagtgtggcaagatgccatgcagaactggcagtacaaaatccaggagcattttaaaaactatgcaacaggcggaattaggtgccctgatattggccttacaaacttttcctcaccaagacataaatatcgttggtgattccgcttatgtggtgtatagtattactcatttagatcttgcacatgtgaagggcattactaataaacccctattagctttgtttcttgcagcgcaagagctcctctgtgcctgtcatcaccctctttacatcacacatattcgccgtcattctgggctacctggtccttatcagaagggaatgcttgagctgatgctctggtacgaccacagatgtgctttgcaaattctcctgcttttttgcaagctcaagctgatcatgttgttttttcatcggaacgcccgccgtcttaaacaacagcttcatttgacacttactcaagcttgcatgattattaaaacttgtcctaattgccaacagcattctctttcccccttttccttagggcttagtgccaacctacgaggtctggtgcctaatgctatctggcaaactaatgtcactcggtgtccaccctttggacgttttaaatttctccatgttaccgtggacacatatacaggcctaatacatgctacctcccagacaggagaaaaaactaaagatgcaatcgctcatttgtttaaatctatgataactctaagccttccacacactataaaaactaataatggaccttcctatcttagtgctcgatttacatatgcattgcaactttggcacatgcaacataaaactgatattccttataactcaaccagtcaggccattgttaaacgagctcatcaaactcttaaagtatatcttaatttaaaaagggcgggggggaatatggggctctcttctagagaacaggaccagtcgttggagaaccaaccaacaatgatggtgatgactcggaaggcacctgacatcacctggggacagctaaagaaattgaatcaacaagcatctatccagcttgccgccgtggaagcccctgcaactgcagacaatcggtttcttacatatctggtggcaattggggaaacttctgagaaagtaagacagacatggatgttggggtggcaggtaattcttgtcctttgctaagtgggatcagcttaaggacatgtttattggagtcatgttctaaatccccctgtttttaatgttattacatggtgggatgctgacccgcctttgtcatctaatgatacttcttgggcaggaggccgatggatgcctctgtcttaccccgtaactgaaaatttgggatggattcaacttaattactcctcgattttattgtctagtaatccccctctttgtttttccacaatagcacatgataagtgtgttactctcatccctcaggagtatctttactatcagcctaaaagggatgctaagcttgcaaacttgacctttatttctactattaccactaatcttactgaggtctctaatgaagctacacaagtgcctgatcttcctatatgccgtccgagtagggactggcgataaaagtttgaggccgtccagtggtcgccgtgcagacagcctgctccacgtcaagggcctctgtttgataatggcaccttacttgattggggtccccgtggtaatcttatgtctgcaaatcagactattggacttgggagtccctccagtagtcctattacctagtcagagtatgggctttcaggaccagtattacaagtgagagggaaacaagctttaagccctgctcatacccaaatttggagattaggatttcctttttttgaacgggttctttcacatggtgagtatattactggcggtggcaaccataccctctctttgcataataatgttactgacacagtcctgatttgtaccacgcacccttatatacttttgtttgggcaaggtgttcctaacatagagcagaatcaatctttttatagtattaaagtctcttccagtagttggtatgctgcatgcttgtccatcgaaacattacacagttggatataacctatgtcatgatcttaaaatggcgtgcagaattgtggctgcctgtaaatttaacctggagctgaaaaggagattccaccctgcagctatttagaaaatcactatctcatactcggaaaaaaaaaaaaaaaaaaagattcctggccactttaattgcctttttagtctcagctattattatattagcaactgctgctactgcagctgtttctctgacagaatctattcacacagcctcagtggtgaaccacatggtgtataatgtaacccgtgaatttcaagaacaggtaaatatagataaaaccattctgtctcgcccggtctcttgaagccgctgttgaataactggggaatcagcagcaggcattcattacccatcaaaatttacattgttgattggcaatataattctatctgtgtcacgcctctgccatataatagctcccaatatgcttgggagagagtgaaagcacatctgcaaggggcttatcacgaccatttgtcttctcaaatttccattcttgagtgtgaattaaagaaacaccttgaagaatggtcgcagcaattacaaacaagtatccttcagcaattacaagaaggctttcaatggttaaacccgaacacttggttgtctgggttaaacatacgcatttgggtgatggccgctgtacttattcttttttgtatctgtttgctaggcacttgcagatggctctgtgctgccacccgacgcatctatgaccagggaagaatcatggaagcttaccttgcattggatgaccagcacgctataagaattaaagaaggggggaatatggcggggtgcacgacagcatattcaagcttatgtacaaggcgtttgaggtcggggcatggaaacatactgaggcactgtgtgtatgttatttgtgcatgagaatgaaactccttgaccctgaaaacaggacggggagtggagtgtgtggtgtgataaggaacgctgaaaacagcctcccgagaatgcggtttgagtgcttttaccaggccacaggtgtctcatgacccgacctcaaaaaggccatctagtggatgtttgtggtctaacaagccctttcaatgaatacttggcggacagatgctggggcggagtctcttagaagagctgcccccggcccccctcagctggatttgtctgagaactcattcttggcgttcactgcaagctataagctctgcgatgggccctgaaaaaaaaaaatcgatactacgatgactctcatatgtatttcttcagcccagatccagacctttgtctactcagcttctccacgtggatacctaataggcatctcaaatttaaatatccaaaaccaaactcctgacattaaacacaagaagcaagaaatatgaacatattttctgattccactaatataaaagtacataacagtcaacaccaaaccatattattcttatttcttgaattgaacttttattttaagttcagaggtacatgtacaggtttgttacataggtaaacttgtgtcgtgggggtttcttgtagaaattgtttcgtcacccagtgattaagcctagtacccattcgttatttttcctgctcctctccatcctcccaccctccaccgtccaataggccccagtgtgtgttgttcccctctttgtgtccccgtgttctcatggtttagctcccacttgtaagtgggaatatgcgatatttggttttctgttcctgcattagtttgctaaggataatggtctccagatccaaccatgttcctgcaaaggacctgatctcattcttttttatggccgcatagtatcccgtggtgtatatgtaccacattttctttatccagtctaccattgatgggcatttaggttgattccatgtctttgctattgtgaatagtgctgcaatgaatatacacgtgcacgtgtcttgataacagaatgatttattatattcctttgggtatatgctcagcgatgagattgctgggccgaatggtatttctgtctttaggtcttcgaggaatcaccacactgtcttccacaatggttaaactaatttacactctcaccaacagtgtataagtgttcctttttctctgcaacctcgccagtatccattattcttttactttgtagtaatagccattctgactggcgtgagatggtatctcattgtggttttgatttgcatttctctaatggtcagtgatgttgagctttctttcacaggattgttggccgcatgtacgtcttgttttgaaaagtgactgttcgtgtcctttgcccactttttaatggggttgtttggttttttccttgtaaacttgtttaagttccttatagatgctagatattagacctttgtcagatccatagtctgcaaaagttttctcttattctgtaggttgtctgttcactctgctggtagtttcctttagtgtgcagagctctttagtttaattagatcccatttgtcaatttttgcttttgttgtaattgctcttggtgtcttcgtcatgaaatctttgcccattccttatccagaaaatgattgcctgggttgcctttcagggattttatagcttggggttttacatttaagtctttaatccatgttgagttaacttttgtgtatggtgtgatatagtttggctgtgttcccacccaaatctcctcttgaactgtagctcccataatccccacgtgttgtgggagggatccggtgggcggtaattgagtcacgggggtggatttttcctgtgctgttctcatgatagcgaataagtctcatgagatctcatggttttataaagggcagttcccctgcacatgctgtcttccctgtcgccatgtaacgcacatcctttgctcctccttcgccttctgccatgattgtgaggcctcccaaggcatgtggaactgtgagtccgttaaacttcttttctttataaattacccagtctcgggtatgtctttattagcagcaagagaacggactagtacctggtgtaagaaaggggttcagtttcagtcttccatatatggctagccagttatcccagcaccgtttgctgaatagggaatcctttccccattgcttgctttcgtcaggtttgtcaaagaccagatagttgtaggtgtggggcctcatttctgggttctctattgtgttccattggtctccatgtctgtttttgtaccagtaccatgctgttttggttagtgtaggcttgcggtatagtttgaagtcgggtagcgtgatgcctccagctttgttctttttcacttagaattgccttggccattcagactctttttcagttccatatgaattttaaaataggtttcctcgtactgtgaagaatgccaaaggtaacttaataggaatcgcattgaatctgcaaattgctttgggcagtatggccactttaatgatattgattcttcctattcatgagcagaaatgtttttccatttgtttgtcacgtctctgatttccttgagcagtattttgtagttcttcttgtagagatctttcacctccctggtgtggtgtattcctgggtatcttggtgtgtgtagcaattatgaatgggactgtgttcccgatttggctctctgcttgactgttgttggtgtatacgaatgttagcgatttttcacattgatttggtatcctgagactttgctgaagttgattatcagcttaaggagctttggggctgagactgtgtggttttctagatttaggaacatgtcgtctgcaggcatactgtagtattaaaagaatgtaatataggacataggacagaaaaacgtagagaaaaaagaggaaagaaggatcacaaatgtaaatgtgttggtttcctcttgaaggaggaatgaggctgagatcaggcagagacaccccaggagctttggggaatgctggcggtgttctcctctgtgacatgggggtgtttctgtagaggtgcccttgataatcacttattaaacaacacacacatattgtgaggttctctctatgtatgttacatttcaaaataaagaggggcaaaattgctaataacaaataacacacatttgtagttaaacacttctcacaatccacagacctggaaatgactgattagttttctgtatgtgtagttttccagttttaagaatgttctacaaatggaatcatacattatgtagagtttcatatttggtgtctttagcacaatgaaatacatataagacctctagaactgcaatgtactctttcttgacctcagtactcaatacgtgttttcctcacttcacaatagttcattcacagtcgattggttttctaaacttgtatatatgtgtagtatgctttataaatatcatatgatagttaactttatgtaatttgttatatcttggtaatggacttttcttaaaaatggacagtatccctaagaataccccgtacatttccattgc

SEQ ID NO: 3475 - DNA, 9259 bp, human; identical to SEQ ID NO: 3474

SEQ ID NO: 3476 - DNA, 468 bp, human
tgagctcccccgacaaggtagccgtttgtggggccagtttcggcctggagggtggcaagcaggctggctcccgcatggccagccccggagccccacggggccagggccacggcctcgatttgggggcgccaggcagccgcgagggcgagagcaggttcacagatcccgaggtcttcagcttcgagtctgagagcgaattgatagagcagggaaaggtggtgctctggggccgggaaggccggcctggcaccccagtcgacgaccaaggggacgatgtggactactcgtcctccctggctgacgaaccagccaccatcgtgccaccggcccagcgtccaagggcgcccctccccagaaggtgccgctgccgaagggtcggctgacaactgggcggacctggaggtcggtcccagtgggagaggcgtgctgggccccagccctggagaatggcggcaggcctccgccggc

SEQ ID NO: 3477 - DNA, 884 bp, human
ctagtgcatccggctgcagagggaaattgaggaccttacacagcagctaggtatgatggagccctggctggggcagggatggacagcggtgtctttctgctggtgcggggggcgggggtgggctgtaggtacaggcggcgtcactggaactgactttcctttggggaagagaaccaaggaaagcctggccctggagccttctgtgcctttccagctaggggtgtgcacagacagcaatgtgtcgtctgaactccgtgtacacttagtccacgagtcccagaactctccttctcttaggagggttagagataccgcatgtgttttccctttaactgctgcctggtatggcttgtacggtgtttgcttgctggctggcttatctgtctttgaaacacgttctgaatgaacggttctggcatggcccagcacctgagaaccactttcccgcttagaaggcatttccacatttaattcaggtgacgggtggatgagtcagtcccagggctggtggggtttctggttgcagggctaggtggttccccacgggggcagggggtgagtttctgtttccctgggtctggagtgcccggttctgcctctctgtttcagcggccatgcagttcttcaacgacaagttccagggcctttgaagtgagtgttgcacacaccgtgccccttcccacaatcccggtagcttaggagggctgtgggctggccctggctgggagccagtccctgagcctgctctgtttcacaggttggagccagcgtccggagctgcagccaagcgagtttcctccttatcctccttagccagggctttttctcttccgctgcatttgcccccttcccaacgcagttcaaagcagtgtgaaataaagtcg

SEQ ID NO: 3478 - DNA, 3911 bp, human
gcggtggtgtcccgaaggcctcactgtttctgtcgcgtggcccgctcagctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgctgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagtaggcccttctcgccctcctctccctctttaccctcctccccccacacctcctctcttccagcacacacctgtttacccatgcctcctctgtcccttgctcgagggttgtcatcgggagcccagggacactagaatgcccgatgggtgtcttcctcataagggcacacgttaaagggagcacttcttgtgtgatggccatgcctctggacgctctgcaggggtcctgcctccgcccgcagagaggagctggggtggaaggcagggctggcagctggtttggatcgggtgatgccttaaagtgtgggctgcaaagctggggcatctaggctcatcaacttcctgattcctccttccctagctgttgcccaacccacctggcaggcggccccgggctatctcagtatccccagtgttttccctggctggcctctgcctcctggcctgaggctgactgagggagaaagtgctaatgagattaggctcaggagtctccaccttaccacaacccctccccacgtgtactcaccgccggcccccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcat

SEQ ID NO: 3479 - DNA, 2016 bp, human
cccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatatt

SEQ ID NO: 3480 - DNA, 468 bp, human
atgagctcccccgacaaggtagccgtttgtggggccagtttcggcctggagggtggcaagcaggctggctcccgcatggccagccccggagccccacggggccagggccacggcctcgatttgggggcgccaggcagccgcgagggcgagagcaggttcacagatcccgaggtcttcagcttcgagtctgagagcgaattgatagagcagggaaaggtggtgctctggggccgggaaggccggcctggcaccccagttgacgaccaaggggacgatgtggactactcgtcctccctggctgacgaaccagccaccatcgtgccaccggcccagcgtccaagggcgcccctccccagaaggtgccgctgccgaagggtcggctgacaactgggcggacctggaggtcggtcccagtgggagaggcgtgctgggccccagccctggagaatggcggcaggcctccgccgg

SEQ ID NO: 3481 - DNA, 884 bp, human
tctagtgcatccggctgcagagggaaattgaggaccttacacagcagctaggtatgatggagccctggctggggcagggatggacagcggtgtctttctgctggtgcggggggcgggggtgggctgtaggtacaggcggcgtcactggaactgactttcctttggggaagagaaccaaggaaagcctggccctggagccttctgtgcctttccagctaggggtgtgcacagacagcaatgtgtcgtctgaactccgtgtacacttagtccacgagtcccagaactctccttctcttaggagggttagagataccgcatgtgttttccctttaactgctgcctggtatggcttgtacggtgtttgcttgctggctggcttatctgtctttgaaacacgttctgaatgaacggttctggcatggcccagcacctgagaaccactttcccgcttagaaggcatttccacatttaattcaggtgacgggtggatgagtcagtcccagggctggtggggtttctggttgcagggctaggtggttccccacgggggcagggggtgagtttctgtttccctgggtctggagtgcccggttctgcctctctgtttcagcggccatgcagttcttcaacgacaagttccagggcctttgaagtgagtgttgcacacaccgtgccccttcccacaatcccggtagcttaggagggctgtgggctggccctggctgggagccagtccctgagcctgctctgtttcacaggttggagccagcgtccggagctgcagccaagcgagtttcctccttatcctccttagccagggctttttctcttccgctgcatttgcccccttcccaacgcagttcaaagcagtgtgaaataaagtc

SEQ ID NO: 3482 - DNA, 2016 bp, human
ccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatattc

SEQ ID NO: 3483 - DNA, 3911 bp, human
cggtggtgtcccgaaggcctcactgtttctgtcgcgtggcccgctcagctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgctgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagtaggcccttctcgccctcctctccctctttaccctcctccccccacacctcctctcttccagcacacacctgtttacccatgcctcctctgtcccttgctcgagggttgtcatcgggagcccagggacactagaatgcccgatgggtgtcttcctcataagggcacacgttaaagggagcacttcttgtgtgatggccatgcctctggacgctctgcaggggtcctgcctccgcccgcagagaggagctggggtggaaggcagggctggcagctggtttggatcgggtgatgccttaaagtgtgggctgcaaagctggggcatctaggctcatcaacttcctgattcctccttccctagctgttgcccaacccacctggcaggcggccccgggctatctcagtatccccagtgttttccctggctggcctctgcctcctggcctgaggctgactgagggagaaagtgctaatgagattaggctcaggagtctccaccttaccacaacccctccccacgtgtactcaccgccggcccccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcata

SEQ ID NO: 3484 - DNA, 70 bp, human
gcgtgtgtgtgtgtgtgtgtgtgtgtgtgtgcgcgcgcgcgcgcgcacatgtgcacgcgcgcgcgcgcac

SEQ ID NO: 3485 - DNA, 9258 bp, human
cttggcgttcactgcaagctataagctctgcaagtggtgaccccgacgtgatcgccttgaagttacgcgtgaaggaggagagctcattacttttcggggaatcctggtaagggacagtcctgactcccatcaggaggacgggacccatgcgtaaactatcgcgggttgggttatcatgggtcaggaaatgaccaaagaacagaaagtattttttaaaacagtgcaacagctacttaaggctatccagtgcactgtagagcctggagctctacacaagcttatgcttttaatttggcagaaatgcccttggtttcctgatcaaggaaccttagatttagggttatgagagcaggtaggtcgctgcctgaaaagaggatatgagcagggtcattttactaatgttactattttgaccacctgggcgctggtacgctctgcgttgtatcctctttatctgccagatcgtggttagatcgcccattatctccacctgaaaagaattcagaagatttgaagggagagattcctctccccacttcattccgttctatggggaataaggaagaggtttttttctagtgaggacaaacaggaaccagaacagtggttggggggtgggggtgctcctctctctacctcattcccttctgtagggcataaggaggatttttttttttttttttttttttagtgaggataaggacggacgggagccttttcctccccctgtagaaaagccattgcccttctttcctccacccttaaaaggacctgcatttgttggccctgttcagccaacagcgccttccatcccccttaaggagattggaggccgcccaagggacggctcttagataagacccccggtcagcgaacatctgtatgatctgtatgattgggtggctgcgtctcctcgactaacttccctgctggaggggtgcgtccaggagggaaggaaagtggctgattatgattgtcttcctaatatgcaagttcccatttgctacttccagcatcagcctttctggccttgtcttttttctgtttcactggagtaaaaggggaagttgcatgctgcctcctgggttttatcccagatagctctagctttcttgctgcccacagaggcctggggcaggagagttgctgagatgccatggagtgcacacttggtcactggcagcctgggcaggttgcccctttctgggtttgtggtgacggagggaaggccaaaaggcacagaccgagtccccgggtggctgcaggcagctccagcccagtcctgaggatccgcctcaccatggtcacgtgccttagtaactgtgcccaggaagtggcctgctgcttgccgtgctgctgcttttcctacttctgcccttccctgccactcctcacatgtctcagttgacgagcaattccttgtcttccctggccccctagggaaagggctgagaaatagtccatgtgcacccggaccttactagcctaaggtgggcaaaggagtgtggagcagcccggagtacagagccctggaggaggagcccactaataaggggcgctctcccatagccatatattaaatgctaactagactgagggggacgagctctgccagctgctgtcatcttcagaagatagacgcagcagtaaggagtgtttgttttgcttttttacaaaatgtttaaaaacactgtggttaagaaacttcaaagcagaccctgtgctgcatgtctgctcctcccctgagcctctctgcttgggggtggtaaaaataataaaaagcccagtatattttcagtacctcacctaacagggttggctgcaggcgtaggtggcctagaagataaggggagtgtttttctcccagcctgttaccttcttgcctccagcctccgcacttccacacacagtttaccacccggtcattctctggcctcttactgccgcttgtactcttccttccttcctctcagggtaaggacagcaacaagtggcaggctattaaaaagagaagctgcctaaggggcccagaacgaatagaaagaaactggccacagccctactttcccaagctcacttctaagacattccagctaaaggctgatgcaggaaaatggctaacaccaaaggacattttaaaaagcttttttttgttttcttttctttttaacacacttaagctaactcaatgcaggtttattatcctggcgacttgcagtcactttctaatggctttcaagggccaaaatatagtaaaaatcacttaaaatatccatcctttccatgccttagtttaacaggtaggctttatcttttgccatttcggtattttatatgttatgtacctgtctcataatccctctaaacttatacaaaagactacagatataatagcttctcttctcataaaaggacgccaacgttgcgtccagctgtcaggataagaccctgctactcttttcctacctttaagcaaggaacaatttcacactctcttagcttgtgatcttgattggcaagtagcaatggctgtctttattggtaatatcagctttcatttaccagcctctaagctcctgaactttttacaaactgtacctgtttaatttgtatgtattgttgtctctgagcctttacttcatgccaccactgtctttacagatggttaaaaaaaaacccaaaaactgaaaaagcagctatagtgtggcaagatgccatgcagaactggcagtacaaaatccaggagcattttaaaaactatgcaacaggcggaattaggtgccctgatattggccttacaaacttttcctcaccaagacataaatatcgttggtgattccgcttatgtggtgtatagtattactcatttagatcttgcacatgtgaagggcattactaataaacccctattagctttgtttcttgcagcgcaagagctcctctgtgcctgtcatcaccctctttacatcacacatattcgccgtcattctgggctacctggtccttatcagaagggaatgcttgagctgatgctctggtacgaccacagatgtgctttgcaaattctcctgcttttttgcaagctcaagctgatcatgttgttttttcatcggaacgcccgccgtcttaaacaacagcttcatttgacacttactcaagcttgcatgattattaaaacttgtcctaattgccaacagcattctctttcccccttttccttagggcttagtgccaacctacgaggtctggtgcctaatgctatctggcaaactaatgtcactcggtgtccaccctttggacgttttaaatttctccatgttaccgtggacacatatacaggcctaatacatgctacctcccagacaggagaaaaaactaaagatgcaatcgctcatttgtttaaatctatgataactctaagccttccacacactataaaaactaataatggaccttcctatcttagtgctcgatttacatatgcattgcaactttggcacatgcaacataaaactgatattccttataactcaaccagtcaggccattgttaaacgagctcatcaaactcttaaagtatatcttaatttaaaaagggcgggggggaatatggggctctcttctagagaacaggaccagtcgttggagaaccaaccaacaatgatggtgatgactcggaaggcacctgacatcacctggggacagctaaagaaattgaatcaacaagcatctatccagcttgccgccgtggaagcccctgcaactgcagacaatcggtttcttacatatctggtggcaattggggaaacttctgagaaagtaagacagacatggatgttggggtggcaggtaattcttgtcctttgctaagtgggatcagcttaaggacatgtttattggagtcatgttctaaatccccctgtttttaatgttattacatggtgggatgctgacccgcctttgtcatctaatgatacttcttgggcaggaggccgatggatgcctctgtcttaccccgtaactgaaaatttgggatggattcaacttaattactcctcgattttattgtctagtaatccccctctttgtttttccacaatagcacatgataagtgtgttactctcatccctcaggagtatctttactatcagcctaaaagggatgctaagcttgcaaacttgacctttatttctactattaccactaatcttactgaggtctctaatgaagctacacaagtgcctgatcttcctatatgccgtccgagtagggactggcgataaaagtttgaggccgtccagtggtcgccgtgcagacagcctgctccacgtcaagggcctctgtttgataatggcaccttacttgattggggtccccgtggtaatcttatgtctgcaaatcagactattggacttgggagtccctccagtagtcctattacctagtcagagtatgggctttcaggaccagtattacaagtgagagggaaacaagctttaagccctgctcatacccaaatttggagattaggatttcctttttttgaacgggttctttcacatggtgagtatattactggcggtggcaaccataccctctctttgcataataatgttactgacacagtcctgatttgtaccacgcacccttatatacttttgtttgggcaaggtgttcctaacatagagcagaatcaatctttttatagtattaaagtctcttccagtagttggtatgctgcatgcttgtccatcgaaacattacacagttggatataacctatgtcatgatcttaaaatggcgtgcagaattgtggctgcctgtaaatttaacctggagctgaaaaggagattccaccctgcagctatttagaaaatcactatctcatactcggaaaaaaaaaaaaaaaaaagattcctggccactttaattgcctttttagtctcagctattattatattagcaactgctgctactgcagctgtttctctgacagaatctattcacacagcctcagtggtgaaccacatggtgtataatgtaacccgtgaatttcaagaacaggtaaatatagataaaaccattctgtctcgcccggtctcttgaagccgctgttgaataactggggaatcagcagcaggcattcattacccatcaaaatttacattgttgattggcaatataattctatctgtgtcacgcctctgccatataatagctcccaatatgcttgggagagagtgaaagcacatctgcaaggggcttatcacgaccatttgtcttctcaaatttccattcttgagtgtgaattaaagaaacaccttgaagaatggtcgcagcaattacaaacaagtatccttcagcaattacaagaaggctttcaatggttaaacccgaacacttggttgtctgggttaaacatacgcatttgggtgatggccgctgtacttattcttttttgtatctgtttgctaggcacttgcagatggctctgtgctgccacccgacgcatctatgaccagggaagaatcatggaagcttaccttgcattggatgaccagcacgctataagaattaaagaaggggggaatatggcggggtgcacgacagcatattcaagcttatgtacaaggcgtttgaggtcggggcatggaaacatactgaggcactgtgtgtatgttatttgtgcatgagaatgaaactccttgaccctgaaaacaggacggggagtggagtgtgtggtgtgataaggaacgctgaaaacagcctcccgagaatgcggtttgagtgcttttaccaggccacaggtgtctcatgacccgacctcaaaaaggccatctagtggatgtttgtggtctaacaagccctttcaatgaatacttggcggacagatgctggggcggagtctcttagaagagctgcccccggcccccctcagctggatttgtctgagaactcattcttggcgttcactgcaagctataagctctgcgatgggccctgaaaaaaaaaaatcgatactacgatgactctcatatgtatttcttcagcccagatccagacctttgtctactcagcttctccacgtggatacctaataggcatctcaaatttaaatatccaaaaccaaactcctgacattaaacacaagaagcaagaaatatgaacatattttctgattccactaatataaaagtacataacagtcaacaccaaaccatattattcttatttcttgaattgaacttttattttaagttcagaggtacatgtacaggtttgttacataggtaaacttgtgtcgtgggggtttcttgtagaaattgtttcgtcacccagtgattaagcctagtacccattcgttatttttcctgctcctctccatcctcccaccctccaccgtccaataggccccagtgtgtgttgttcccctctttgtgtccccgtgttctcatggtttagctcccacttgtaagtgggaatatgcgatatttggttttctgttcctgcattagtttgctaaggataatggtctccagatccaaccatgttcctgcaaaggacctgatctcattcttttttatggccgcatagtatcccgtggtgtatatgtaccacattttctttatccagtctaccattgatgggcatttaggttgattccatgtctttgctattgtgaatagtgctgcaatgaatatacacgtgcacgtgtcttgataacagaatgatttattatattcctttgggtatatgctcagcgatgagattgctgggccgaatggtatttctgtctttaggtcttcgaggaatcaccacactgtcttccacaatggttaaactaatttacactctcaccaacagtgtataagtgttcctttttctctgcaacctcgccagtatccattattcttttactttgtagtaatagccattctgactggcgtgagatggtatctcattgtggttttgatttgcatttctctaatggtcagtgatgttgagctttctttcacaggattgttggccgcatgtacgtcttgttttgaaaagtgactgttcgtgtcctttgcccactttttaatggggttgtttggttttttccttgtaaacttgtttaagttccttatagatgctagatattagacctttgtcagatccatagtctgcaaaagttttctcttattctgtaggttgtctgttcactctgctggtagtttcctttagtgtgcagagctctttagtttaattagatcccatttgtcaatttttgcttttgttgtaattgctcttggtgtcttcgtcatgaaatctttgcccattccttatccagaaaatgattgcctgggttgcctttcagggattttatagcttggggttttacatttaagtctttaatccatgttgagttaacttttgtgtatggtgtgatatagtttggctgtgttcccacccaaatctcctcttgaactgtagctcccataatccccacgtgttgtgggagggatccggtgggcggtaattgagtcacgggggtggatttttcctgtgctgttctcatgatagcgaataagtctcatgagatctcatggttttataaagggcagttcccctgcacatgctgtcttccctgtcgccatgtaacgcacatcctttgctcctccttcgccttctgccatgattgtgaggcctcccaaggcatgtggaactgtgagtccgttaaacttcttttctttataaattacccagtctcgggtatgtctttattagcagcaagagaacggactagtacctggtgtaagaaaggggttcagtttcagtcttccatatatggctagccagttatcccagcaccgtttgctgaatagggaatcctttccccattgcttgctttcgtcaggtttgtcaaagaccagatagttgtaggtgtggggcctcatttctgggttctctattgtgttccattggtctccatgtctgtttttgtaccagtaccatgctgttttggttagtgtaggcttgcggtatagtttgaagtcgggtagcgtgatgcctccagctttgttctttttcacttagaattgccttggccattcagactctttttcagttccatatgaattttaaaataggtttcctcgtactgtgaagaatgccaaaggtaacttaataggaatcgcattgaatctgcaaattgctttgggcagtatggccactttaatgatattgattcttcctattcatgagcagaaatgtttttccatttgtttgtcacgtctctgatttccttgagcagtattttgtagttcttcttgtagagatctttcacctccctggtgtggtgtattcctgggtatcttggtgtgtgtagcaattatgaatgggactgtgttcccgatttggctctctgcttgactgttgttggtgtatacgaatgttagcgatttttcacattgatttggtatcctgagactttgctgaagttgattatcagcttaaggagctttggggctgagactgtgtggttttctagatttaggaacatgtcgtctgcaggcatactgtagtattaaaagaatgtaatataggacataggacagaaaaacgtagagaaaaaagaggaaagaaggatcacaaatgtaaatgtgttggtttcctcttgaaggaggaatgaggctgagatcaggcagagacaccccaggagctttggggaatgctggcggtgttctcctctgtgacatgggggtgtttctgtagaggtgcccttgataatcacttattaaacaacacacacatattgtgaggttctctctatgtatgttacatttcaaaataaagaggggcaaaattgctaataacaaataacacacatttgtagttaaacacttctcacaatccacagacctggaaatgactgattagttttctgtatgtgtagttttccagttttaagaatgttctacaaatggaatcatacattatgtagagtttcatatttggtgtctttagcacaatgaaatacatataagacctctagaactgcaatgtactctttcttgacctcagtactcaatacgtgttttcctcacttcacaatagttcattcacagtcgattggttttctaaacttgtatatatgtgtagtatgctttataaatatcatatgatagttaactttatgtaatttgttatatcttggtaatggacttttcttaaaaatggacagtatccctaagaataccccgtacatttccattg

SEQ ID NO: 3486 - DNA, 9258 bp, human; identical to SEQ ID NO: 3485

SEQ ID NO: 3487 - DNA, 232486 bp, human
tgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaaataaatgaacattgtcatgtcttgcccttttttcttccctatgcgttttcctcctaggattcccactcccttactgaccattttgctgggggtcagcattttaccctgcatatcctccatctgtctggattgccctcagattcttcctctagctatttattttgaccatggggcaggagaaacctgggaaggtgggaggaaggttggaaagcaacatggccagagtgaatgacagctgacaggccagcagtatatagcctccctgcagtgacaacttggctgccactgactgagtagtggcaagtcagactggcctatagcctgcaggctgggctggggccctgagaagcagcaggggaggacagagagaggaggagcgagatagaggaggagaaagtggatgctgaagaagttgaaggtgcttctctacacaatcacaatcatgggtcatgcccccaccatcttcaaggttacaggggtggactgggctaggctagttgcctcgcaacatcccacccactccactgaaggctgttctttggtaacatgaacccctttgagactgccctaaaagctcttgtaactggtatggtgtgggagatggggatggaaggaggagacggtagaccacaggactgccgaaggcccctgtggttgtggatctgtggcagttgccacaccctaggcatggccctgcctataagttgaggttttccccacatctggttttgaatgtgtcctgttttatggcatctgtggcctgtacactgggttcttcatctaaaaaatggtgtagtcaaagccattgggaaatagctccatgcctgccaccatatgctgagtcaatctaagctttccaacttctcccttggagatctatataatgtttgtaggtgcttagatgataattacaaaagcaatcaggccatccgcgtagggatataatatctcctttgccatcaaggaagtcactgaagggctagataattctaggtatgtttaataacactggaaaactatcatgttacactagctcatgaacttgctgtgggaaagatgttctgttgcttcttacaattattttggcttgaatacagccagttgggtccgtggtgaaaactccctcttcatctttatgtaaaattcctacttcttgattttccaactttatggcaactctggctccaaatcagaaaggacagctggtttatttgtgtttaaatcataattccagtgtgaggatagactgttgtaaatctatacggagatgaaaaaatgaaaaaagcacctccagactgcaatgagtttgccattagatgaggtgttgtggaccctgagtctgaccgtccttgctaatgaagagaagagatggcctcttgagtcagatggagtggggagggtggcaggaatttggggacttggaacaggcactcagccagggcttactttgtctctgtggtacgtttcatcccgaggctcttgggacagagggttgacagagtatggagggagaagcaaacccattttcttttctcttcccaccccaccctgctttccattttctttttaaataccatgaaattcctggtctgcttcatggtatttccatgtgttgaaaacatcttccctggagatttggataccaaaatgtccactagaatttcttccactttagaaacaagacatttaatcttctcttttttaagacacatgaatagctaaagtgataaaagtgtcaggatgttggaatagtagagtaataggagaagattcaagttatggctcttgggctcaaccttgaccttgacgacattgattaggttttaggaggagagtggtatatttacatcatctgttcctgtacctctctggtgtggtaccaacaattcagtcattaaccaccatatgtgtcataacacttgacatcccggacccagaaaggggaaggtacctgtccaaaggcacccagctggatcaagaccttcagtagtcatgagtgctgaaaagattttagtgcctccccatatgtaattccaagtgaaagcaatactaaacctttaaacaaaaatgttactctttttaaatggctcaaagctcacatggatgttgaaattaaaatatcttactagattctttctcccttcctctctgtcttttgtacccctgctgttggtggcctaatcatgtatttaatctgctgatttgggaatgtggtaccggctgggtcacacagcaggtcagtgacaggaggcctccacctagaagccatgccttctgacaaccagactagtgctctgccctctgcagtgatgctaagttcaaagtcagttgttcttcgagagtcattttcttggcattttctctagttggaacttgtccaggatgagaaataactcctgttacctttagtaactgagggcaccctgtggttctgtagttgtggccgggggtgagctgaagctggagaggagaaaggaaggtcaaactttctcatatagagaatatagagaataggtgtgaggcaacaggctctcttgttaaagcaaaacatagtcttctttgaatggaaaattgctccagaaaaaggatcttcaggtgggaaggggtggctggccagtgaccctgacactgttgcaatccctcctgatccctctgccatctttatacctgttcttctcccttgtagctttcaatccagttgtagacactacttgccacacacctgcatcctgactattttctgttattctagtagaggctggttggcatttcagaaggcaccttttattaaaaaccaatgggaacaagaaagtaacattattaccaaaagtgcatttagcatacacatttacagggtatggatttcttatccttcagtgctcaagtagcttaacaggctcactggctttgctgctgtattccctttctgaaggcctcaaatcgtcttttccttagatcattattttctagcctcgaaaagtgggcacaactgcgtctggaccctgtctgacctttgtgctgggtgctaaagacccagaggtgaataagacccaatgtctccattcgaggagctgccaagctgcagaggtaggtgccatctcattcctgaccacatcagcatgtggtgcctgggaatcaggtcttatttaggtggaggagagctgataaccagaaccaggaccctagttcacataccagaagattcttctgctcagtccggtttggcgtccaaagatggaatttggacttttagaattccctatggtaaaaacaaaaataaaaaccaatctgtcattctgttagtgttattgtgaatttagcaatgcttttaaatgaatttgcagttttaaacactataatgttatcttcatgcatatgaagagtagtgcttattcagtccatagacaatgcttggtggatctgcaaactaacagacttcttgtgataactctatggtcctctagagtcctctactgtcagttgggaatcgctggccttcctggttcaagctatcagctctcccctgctctgtggaactccacaatttcactcaaataagccctcattgaagttttcaagttagagggcacaggatggcaatcttaacagtcaagactactttaataatgccacaaacaggaggtatgtttattaagtgtacaggtagtttgcagtaaagtgctttgtatgaggtcatgcacaagaccactaggtatcagccagttaacttgggaggtttgagcaattaggcagctcttcctccctcccttcctctctccctcccccctccctccctccctccctccctcctttcctcccttccattcccttcctccctccctctctttctaaaatgtaagctcctcaataagatataagctccttgagggtagtagtctttatctgttttcactgttgtgtctccagctcccaaaacaatgcttggcacctaataggcacttaataaatacctgttagattgaataccttctttctttctttctagctatcgcacactctttgagtacttgactctgggccctgccctgtgctgatttctgggggtacagagtagaactaggatgcaggcccacagtccagtggggagaacagtgagccatagtgctgtggagataaggtctaggctaccggggcaaggcagaggaggcacacctgactcaggacagaggctgagcgaagcttccaggaagatgtgatgtctgagttctgaaggatgatctggagctggccgttgaaggttgaagaaggtgggggaaggaattcctggctcaggaagtagcctgtgcaaagccctggatatgtgagagagctggtgtgggggaggaattcactgccagtgattcaggaggagagggagcaaggcacctcctgactcagaataagcccccagggtggaggtggggtgggaagttcctcacatcctgtttgttcgtcagggagttggatatgagggtcttgagaaggttaaactgcatggttcaaatgaagttgtaatattaactaactgtggattttctttatctacactcaagttttcattatccttgggcagatgagacccaggcaacctcggctccttcatgctttgcagggccaggccctgggcccctctaaaaaggctagacagagcaggaggggctccgagccacagtgagaaagagagagaaagcaagagtctacctgcctgtgtgtccccggctgtgtgtatccagttgcactccaaagctaaatgtattatttatgcccctgcttttctgtgagtggggaaatttgaggcttgacgatatcttttattattatttttctttctgaatagcatagattcttcagaatcgtctgtaattcatcaaggggaaaatcagaattttttttttttttttaaaatggactcaaagaggagatgagtttttaaaaaatatctatcatctgtttttattttgactggaatcatttgcttccgagcacagtgtaattagctgcctgacaatttatagcctgatccccagtaactgaaaaataccaaactcaaattattcccccagactaggaggcccggaggtgattgaggtctccttacgttaacatcctctgtccttgggggctgagggggagggcagttctctgcccttgcaggaggtggtatctccgagttgtcagcaagacaggccttgttgttatacactgagtgtctcctttgactcagtaattccatttccaggattttatgctaaagaaataatcagatattgtggggggaaaaatgtgcagggaacccccactgcattttttggttatttgcattagccagaaaaaggaaaataacttacacattcaataataggggagtggttatataaattttcctaggtctatgtgatagactaatatacagccatgaaaagctatgctctaaatgaattataaggctacatggaaatgcacaaaataatgctgagtaaaaaccaaagataaaatttactactatatacaatatcgtctaaaacagagcacccacacagacacatacacataagaagaaactggagaagcctatgccaaaatgctgacaatgattatctcagggtgatgggattatggggatgagtggtagtattttccttctaccattctgtatttgtcaaaatttccccaatcaacatctattacttttagtaaatagaaaagacaatggatgacatgttaaggaaaaggatctttggatttggaatcgtcagcttccaggtgaagtcccacttgcccagcacctactatctgactctagtgtctctgagccacagttcctcatctgtaaaatggggttaaatactacccagttcacagggttgttgtgaggatccaaaataatgtatgtattaatgaaatgcctggtgcctatgctgcaaccatggacaccatcactaaatactaagaaggtgaaattccacgaagcttgctgaaatccctggatgggggtactgtcaagatgaagttataataagaatgttcctagacagctatgaattgcagccattcttcccttttccagaatatgtaaagaatgtttgtgtgcccacggaggagccgcatctagcctttgaggctgtcagctcatctttcccaacccgaggattttcctttcctctgactcctcccttcattctcccccactgacatctgttcactgcctcgccaaccaagggggaaaacattctttggaactgaagctgaggcaccaccaagagtcaaggcagctatgagatgtttattgtcacagagaatatgtggtgctggctgaccacagaacctgccaggctgggatgccaaggagggactttaatgaagcagcagaggatggatgcaagccgcatagccaggcagtgtcccctgcctttgggcagagctcttgtccaagtgtctcactggctctctgttttcttccccttgggatgtctgcatggctcctggttgagctcaccagttttacagaaccagcctggtttatgggtgaagaaacaccttctcacagaacttatggggcctaagcgtgtttcagtaaagtactgggcagtttgcctgagggcccagcatgcctaactctcaccagcgtggatatgaagcgaggaaaacctgagctcacagccaggcagcctcaaggacataggcacacctcagcagtgtctacaagatgccctggccaccaggcaatccagccatctccctgggtagaatccttcacactgcatgtctgattgcatttttcattttttaattacagccgtagactcatatagactctgactgccaatctaaagcacctagagagtttttttaaattgttaatgttttgctaaattcttagtaattatacaaaatcattatgtagaccaatagatattattgaccaagatatagtgatgcttaaaacaaagtcctctgtaatcagtacaacatgttggtagaatttaccctaaatgttaaaaaaaaaaaaagtactaatgctgtggctccaccccataccaataaatccagaatttctgggggatgaggcccaagaaacagtactatttaaaagttcccatgtgattctaccgtgcagcttaggtgaagaactcctgttatagatgttaaagctgggagagacccagtttcctgacttatttgaacacgcaatcctttacaaattatacttgtggataatgagcatgaactatgatgcagacttagattaaagtaagtgacaaaaaaaaatgatctcgcagatgaattaattgtaagcagtaataatgcgaggttaggttacatatatattttgtttttgttttttttgagactgagtcttgctctgtcgcccagctggagggcagtggtgcgatctcggcccactgcaacctctgcctcccaggttcaagtgattctcctgcctcagccttcctaagtagctgggattacaggtacccgccaccatgcccggctaatttttgtatttttagtagagacggggtttcgccatgttggtcaggctggtcttgaactcctgacctcgtgatccgcccaccttggcctcccaaagtgctgggattgcaggcgtgagccaccgttcccggccaatatattttttaacattataagagaacataggggttgggcacagtggctcatgcctgtaatcccagcactttgggaggccgaggctggtggatcatctgaagtcaggagtttgagaccagcctggccaaacatggtgaaactccgtctctactaataatacaaaaaattagccgggtgtggttgcgcatgcctgtaatcccagctactcaggaggctgaggcaggagaatcacttgaacccgggaggtggaggttgcagcgagccgagattgtgccattgcactccagcctgggtgacaagagcaaaactccgtctctgaaaaaaaaaaaaagagagagagagaacataggaaattagaaacatgaaaccattttattttattaataaaaaggataaatatatgatgaagtagagtaaaacatcttttattttacatattttggttataacacgtcatcaaaacccactaacattttaaacaagaatagcatttttgttttcttacgtcaccgccacttaatatcacccatgatgttactgggttggatccctacaccaggtcaatctcaacttatttttctttgcaacagaatataacgactccactatgcacgagttcatcggagtataggcaagaggaaagaaacttccagtcgtaatatttagtgttctgaaataggctgtgccagaaattccaaatagaagttggaatggttgcctccaaatcaacgtctagatcagactctgtgctttcccgtgttctctgatgtggcacactctttcatgcaggtagattattgtgttaataatacggcataagagtgaaatgtattatccacatttgtattttgtatttgtatccacaaatataatttgtaaaggattgtgtgttcaaataagttgggaaactttggagtggtctctcccagctttaaccatctataacaggggttcttcatcccagttgcacagtagaatgtataaatgtattgagtatttttaatcccatttatacttcaacaaatgcaatgcagaagaaagagtatttatcttttttcccttcatgatcgcaacagaaatagttttagaatgtggatctaggccaacactcacccagagaaaggaagaggactggggcaaagggatctctgggtaggtggctgtgtgtttggatttccagtgcagaacctctcttgtggctattttggggtcctgagacatccacttatgtgaccctgtcagcagcccccctgggaaatacgaaggcaagggggacaaagggaaagggagaactatggggggcacttttggcatccctccatagtgtgatcagagaggggagatgctaaaggtaacccctatagtttgcctcccaagcaatactgtacatcgaggatgataaataaggcatcaagaataggctgtaggtgggagaggtggcacgggcctgtagtcccagctacttgggagcctgaggcgggaggatcccttgagcccaagagttcaaggccagctggggcaacatagcgagaacttgactgtatttaaaaaaagaaaaagaggcttcagcatcttcagaggaatctgtttaagaaggctgagaagggtgtgttcaggaagagttccacttgaaatgctgaaaattgaagaaaagattaaatactgaaaagtgggaaacattccagctcccaggaaacttacccattaagagaactcatttcttgaggattttggatagcaaagtctccctgtattccaatttccagcctgtattacctcttggaataaagagttacataagtttactgcctgttgcgaaatagcccaatgaaatcttttttcccataattctgagttaatgaaaatggtagatttaggaaacaaatgttattggcttgcacagaagttttatattttgtgtctgtagcttccagactacctaatgcacatggggtgtggggtcatgagggaaggggaagagctagtgaaggagaaggttctctttgtcctattaaatatttatttcactctcgtaagatgccagagggagctggtagaaatttggcaagcaggtgtcccctccaggtagagggatggcaaagggtgctttccctgggtggattaattaggagaagccactctttttggtggaatctttagacaggcacatcctctgggaacagcaattagaaaaagtccccttttctggtaataagtattaaaatatggagtatcctctgggtggaccaattttaaaaagtcaccctttctgggcatagtaactagataaaggtacttcttcctccatgtgcagtcagacaaggcattgggcttggctgaattgtgtctccaacttgagacccctttgcagggtacccttgtaggaatacaacttgcccaacagtataagtggtcctgtagtgccaggtgccaccaggcaccaggtatacagaaatatgtcagtgatataccctgttcttggataatttataggacagcccctctaaatccccactggctttaactcgccccatctgctgccagctccacccctcctgcgtccctgctggcagagctactctctatggtgatgaaacatccaccctccagatgcccaggctgcaggctgttgtttgacgtggctgtgctgctcctgtctggggatccaggctaaatgtctgctttccacaatgaacagccagagttactggttaattgtggtggctcattgcttctgggttctagatgggaaaacatggaaatcatttaacacttcactatggctttaaaacttttctgtgttctgtttaaatgggctttgaaatggtgagttttggtgtagctgagatatttctgccctttaattttcctgttctttaataaaggaaagcagtttatctttaatctggtgatttagagctgactctgaggggtaattcctaccccactcattgtactataactttgccaggctttttgccaggtattggtgataccaaagtgaaaagacttaccttttgctcttcagtcttagcatttagttggggagacagtatggaagaagacaactttgctgcagacctcgctacagaccctttcacatagggtccaatgtgaaaagcacagagtactgaggcagggaaggttttcatagcattttcctctcgtgtcttccggaaaactcttattcattcctccagatttctattcaggcattccttcctgtttacggccctctctgactcccttcactatgttcctgctatacttttttcactatgttcctccaggtagcctaccctatgggtaggaggcagagactgccagtatgtattgaccatttttgaattcatgtttatttccttcttttaccacctcttgaaaagtaatatgaccctcttctttagaacttgaaagaacaccctggccatcccttggcctaagataaactggaagctagaagttagaggtctcttcctaggagaattaaagcccatcttaaaggttgtgaggatttggaaacagagtagaactattgaggccttctgatcccaatacatttagatgaatataaagagttccttctagctcaagggaaatcagagttacattaggtggttgtaggctagtgacgggcctttgagagtagaaagagccctgattatgaacttggcttactttgctaattttgcccaatgtaagcccaattccagtatttgctaatggaggtaatttttggtgttgagcctctgttttctgtttgtcaggaggatcaaatgaaagcctgtatgggaaaaggctttgtaaacaaaaaatcaccccccctccccaaatgttatgtattatcatcttttagggcaaggatagtggctgactcattcctttttcttcaaaatctagtttggaagtaggcacactgtgaatgtttgttgaatgattaactggcctagtaagagatgagtttttgtgtttctttaaagctctgcatgttatctaataaatccgctatattagttaatgcctacccttagcttttttggtaatttttgccattaccaatactgtgaacctcgtaacacccaagaggtggttattgactcctagatattttgcctgcaataggatataccagtgccaaattgacagtggtgtctgggctgatgcctcttgtcttaagagcttaggtttcccaccagactcctcaagggttgtattttattcctgtctgttttcccccactgccctggtatgcagtaagtgctcaatacatattttctgagtgactaacagagagagggagtggcatgtttttgcacttttttttttttttttaagacggagtctcgctctgtgacccaggctggagtgctggagtgcagtggcgcgatctcagctcactgcaagctccgcctcctgggttatgtttttgcacttctatttggccagccaaataaactccagatagcagaaagtgacagatgtcacagctagatcaccctcatcttacttttatacttgagatgacactccttttctaatttaaaaaacctttggacaaaaacccatgtttttattgttatctttaagagctttctgtgtgcctgacaatatatacatcattaactcattttatcctcacaatgattgcatgaaatagttaccattattatctcaattttcttgataaggaaacaggctcagagaagagtaaacaatttagagttatggagtaagttgagcatccacaatttgaatgcccatccatgttctccatcacaatcaatggggaatagattttactgaaagcaaggatcagaaaagaaatgtgtttttaccactatcagggaggagattttgttcaatgcactgagttgggataggatctgatggagggctttctagtggattgcaagagattcagcaggaacatatccaatgagattaaaaaaagagttaaaatgtctgggggggcacagggagaaaaaacaggaaattgagttttctctgtgaaattaactagcatttttgcctttctttctaatttatgaagctcttttacatttgttatctcatgtgattcccatgacaaccctgtgagttattacttctatttgagaaatgaaaaaaatagactcagagatattaaaactgacctgcccacagtggcaagtgggaagtgaaaaccaagaaaccatttgcactgttttaggtggtggagatacaggagtgaacaagagaggccaaaatatttgtcctcgtggaacttactaggtagataaactatgacttatttcttttcaattaccctctgtcaagtaatagatactggttttggttttcaaccttaactgtattttagaatcaccgggcacactttgaacaaaacattgatgtgtgtgtgtgcacacacactcaaattttaaacctgctctcgggggttttagtgtgcaatcaagctcaagaaccgttggtttagagcagtggttttcaaccttggctgttcattaaaatcaccttgagaatatacatatatatacatacaccaatgtctgggctttacctctgaggctaattaaattaaaatctctgtggttgtgtccagacatgtgtacttttaaaatgtgcctcctcaaatggtgctactaagttcagggtgtggggtttacatgaagcacttgagataaagaatagcttggtcccatttcacagactgtgcccctcacctcttgagcatatgaatcatcggtccttcattcttgcaacaaaatgtttattgagtacctgctgtatctctggtgagttccttctctttcctgggtcctgattcctccctttgtaaaatgagagactggggtgtctctgagacttattgcagctcggtctataattctataaaggagagtgggctgggaatgttaatggctcagaggacccactcttggagacccaggttaaattatttgtcctcttgacagtactgtatgcttcatttgagagacagaaattcatgaaattccaaaaatacgcgagcaagccttctctcactaagcagtttgtccacaaggagcagatggaatcttcttccttcgtctcattcaccatcttgctgaccatcgggttggcagcacaaatgtgcatatgagggccggatcagagggagggactcaatggggtcaggctgtgaaagtcagccagagggaacaagaaccaaaaatgtgccttgaagatcaaaagcacctggaagcagcagaaagcgagctagaggaaagcagcctaccacttggcctaattttcttttgcacctagagttggtttaacactgacagaagacggataataaggatagctgttgagaggtagcagagttagcatagcagtgaagtgcttgggccttggggccaccctctctgggtttgaatcctcactctattacttgttttctttcttttttttttttcttttctttttttgagacggagtcttgctctgtgacccagacaggagggcagcagcgcaatctcagctcactgcaacctccgcctgctaggttcaagcgattctcctgcctcagcctcctgagtagctagattacaggcgcctgccaccaagcctggctaatttttttactttttttagtagagacagggtttcaccatgttggccaggctggtcttgaactcctgatctcaggtgatccacccgcctctgcctcccaaactgctgggattacaggcctgagccatcgcacccggccctactacttgctttctttatgaccctggacaagtagcctgacatctctttccattagtttctctatctgtaagttagggatcattataataatagtacctactttatagacatgttatgaagattataagcctggcaggcattaaatatttgtcacacaaaatttataagtaatacttctaagtgttgagcactttacttgtatttgcttcttaatctttgctttatttgaaacaggtactattttcccaattttgtagatgaagaaatccaggcatggagatgttgtcactgtgtcattaactaagttagtagttattgcaaaaaatgagctaactagtaagccacagagccaggatttgaccctgggagaattgattctttagtgcccactcaactgcaggattgtataggactgcacacagccattatcttaggcttgatacctgaagataaaggaactgaattgggccctggaaatcctgaaaagggggaaatatgggtctcacccagaggagttgactctgtgggtagggacagcagacatatgcataagaagactgcaataaaagatgctttgtgcctaatgtcatgggagttcaaagtggccagtgacaggtttgttgtgatgcttggctttggactggatccttgatggacatacagagtgtgccctgggcaaggggagttgcatgagcaaaggcaaggaggtaaggctgtggatggcatttttggagttggggaaagcactgtttcccctctaccatatggtatagaagcctgggtggcccctcaaacttggtgccaaggtcgaggggcacctggtactactgggcctctttttgggaccccagggaagcagatggtacagaagcataaacttgggctgtcataggtggtttggacatccagtccaaacccttcatagcatagatagggaaactaaggcccggagaaatgaaagacttagccccagcaagccagcagcaaactatggaaggttttgtcaggccaatatttctgccatgcagtgatgcataagagagcctgggccatatcctggagatataattgagtagcacacaaatctactgtagtacccagaagtcttcttcggaacttgattccaagttttcttctgcttaactccccatactgtcatagatggagtcttaaacatgaggtttggcagacctaccgtggaggcagttttacagggcaagctgagaggaagacagggcagggacccaacatgatgtgaattatcccctaagactttgaagttctcaggtgttttcataattgttttttaagcatgagataaaatacctaggcttacaaaggaaaacaatggtactgaaagatagttatcaaaatactttttaaattgtgatatatagtagtatatgtgcttcttagcatatttcaaattacaagatctagcgctgggtcttataattaccaaaatattgaatgagtgaaatttcaagataccttcaacaactgtcatatgatctgtgatttctattactgacaaaggcacaggtattgctaacacttctgtggtttgttgcctacattcatcatttcaattagagtttagtgaaaataaacagttaattattttcacatacaagttcacgggcctcctgaactctcttcatgtaacacctggttaagaacttaatttaactcattaagaatccctgtcctaaggcaaagccgaagctggagaactgacccagcatgggatcttaatcctgctctaagaaattgacttgaaggaggtgcttgagtgccctgaaactctactcaagattgtagtgtgcatggatggttttcattagtgcaactcactgagtagttctggctctctttctgtttctttctcttttttttttctttttggcggtgggggacagtgtcttgctctgttgcccaggctgaagtgcggtggcatgattatggctcgctgcagcctcaacctcccaggctcaagtgatcctcacccctcagcctcccgagtagctaggactacaggtgtgtgccaccacacctgactaatttatgtattttttgtagaggcggggttttgtcatgttgcccaggctggtctcaaactcctgggctcaaacaatctgcctgcttcagcctcccaaagtgctgggattataggcatgagccaccacgcccagactctggctgtccttcttccaggaacatggcaggattgcacttcctcacccccttgcaattaggggtggccatgtggcttgaacctcatcatattcagaattgattccacattctatctgccctgcccacctctcttacctcacctcccacccgtttcaccgggtctacttcagctgtgctggcctcatttctgttcctcaccaagcttattcctgcctcaggatccttgcactagctgttctttttggctggaacactcattccccaactcttagtatgactggctcattcttagcctttagaactcactgttcaccttatttttaacagctttattgaaaataattcacataccatttaattcccccatttaaagtgtataattcagtgccttttagcatgttggtggagttgtgcaaccatcaccacaatcaattttagaacattttcattaccctaaaaggaaattccattccccttactggtccaattccccatcttcccaccagtccctggtaaccactaatttactttgtgtctctatggatttgcccattttggaaatttcgtattaatggagtcatataatatgtagtcttttgtgtctggcttctttcacttagcatgttgttttcaaggttcatccgtgctacagcatgtatcaatacttcattattttttatggctgagtaatattccattgtatggatggaccatagtttgtttatccactcacacattgaagagtatgtttctatggcttgttcctatcctttggctattatgaataatgctcctatgaacatgtgtgttcaagtttttgtgtaaacatatgctttcatttttcttgggtatgtacctaaggaatggaattgctgggtcatatagtaactctacatctaacttttgaggaactgccagactgttttctacagaggctgcaccatttgatattcccatcagcaatgtacaagggttccaatttctctgcatcctcaccaatacttgttattttctgaattttttattatagccatcctagggagtgtggagtggtatctcattgtggactaaacatcttttcatgtgcctagtggccatttgtatgtctttttagataaatgtctattcgagtcttttgcccgtttttgaattgggttgtttattattttgttgtggaattatagttctttatgtattccgtatattaatccctggtcaggtatatgacttgtaaatattttctctcattctgtgagttgccttttcactttcttaacagtgtcctttgatgcacagaagttttttaaatttgatgatgtccaagttacctattttttctttggttgcttgtccttttgccatcatacgtaagagaccattgtctaatctaagaacgtgcaaatttacatgtttacttttaggagttttatagttttagctcttatattttggtttgtgatccattttgagttaatttttgtatacggtgtgaagtagtggtccaacttcattctttgcatgttcttggatatccacttgttttagcgccttttgttaaagagactattccttcctccattgaatggcattggtatccttgtgaaaaatcaattgactgtaggtgaatgggtttatttctggactgtcaattctattactttgatctatatgtgtatccttatgccagtagcacatagttttgaaaactttgattgctttaattacttttgattactttgtagtaagttttgaaattgggacgtgttagtcctccaacttagttttttattttcaagattgttttggctattctgggacctttgaatttccacatgatttgtaggatcagtttcttcatttctgcagcactgccttatttttgcccagctgtttactgtttatcaaggatatccacattcattttttctttcgacaaatattgattgagcacctaccatgtgccagacactgtgccaggtgctgtgaacaattagccatggcccttgccttcagggagctaagcatttagtgggagaagcagacattagtcaaataatcaccaaaataaattttaaatgaatgatagaaatgattgacttagtcgtgggggaccaagaaaatccttcctggagaaatcaataattaggaaggtgcctgagttggaggagatgtatgggaagagtattccaggcagcaagaacatcgttctcaaaggcgagaaaggaggatgcttttaaggaactgcaaggagacgaatttgatgacctacaagcacaagagaaagagcagcatgagatgagggcgagctgcctgagggggaccaattctacagggtctgtgggccaccgaagcaaagaagtaacatgatctgattttgatttcaaaatgctcactctggctgctgtgctgagaatggactggagaggggtgtgcaagatcagtgccagttaagaggatattaccgtagtccgagagagagatgagggagggctagatgaaggtggcgatggcaaccctgcagaggaggtggacagattcacagatgcaagagaaatggaggaggtttcagagtcagtccttggttcttgaggcctatgtgatggtgttggcaggggtggtcttcaccaaaataaagagtacatgagtgtaggtggctttggaggaatcattgttactgagtttgagatgccttccagatattattaagttatctgatcctcactccaaatcatccctatgagaaaggtgtaagactcttctcttcattttgcagatgaggaaactgagtaccagagaggttatcatggtttgcccagtgctggcctgccaataagtggcaaagccagaccagaatcctgttattctaagaacaacccttgtgctttttcttttccatgacaccagagctgactccctagaaaggcccatcccaaatagtttccaataataagtgaagatcactactaggacttctcccacagacaccaagtgtttcccagccctccacacctatgctcccagggaagcattggcctcctttttacagaattcatctctacagcattgctaccaagcccctccaggagtgtttagatcttccaagtatctgatttgtaaacctggatttgttgtttgtgcacagagagctacactgcctcttttcccagtgagagtcgccctgtccaaaagccttcctttttctctactgttagagacaagggtcacctgtcagtagtcaatgtatggaaagctgaaatgctgagacattgagccagaagatggatgacagaaagactaataatagatgacatgtcaaggtgcacttaacttttttttttttttatgttcaagtagaggactgtgaggagaaggaattgaacaggtggcaggaaatggggtgaaatgaaaaactaggagaaagtaaaacaaatacataaattcgaggagtaggaaaaagagaaaataaagtagtgaaagacataggttggggaggagatatcctagtttcaaatcaggctctgacatttattagctgtatgatcttaggcaagttgctcagtgtctctaagtggacataaaattgcactaactttatggggtttgtgtgaggattatagggagagcatgtaatatccttgccacagtgcctggcacaagataagcactcgataactgtcagctgttactatgacgtggaagcccttcctcatttctgctgcctctgcttcccccagctatccccaggcaggttcattttggccagcttggttcaccattccagccactgagccaaaatcccaactgaggcaggaaatattgcgttggcttcagcagacccaggagctggggaacttgtgacaacagctggactctgcattggttcctggggcttcttgctgccaatttgatctgcgatcaggcacctccaagagcgacccttggagatccatgctgcctctaggttgtttcctcctcccttcctttccttcctctttccctaccacccccaccatattgacttctactaaattctgcctactcactcttctttgtattccagttctcctccaggaccaaagtcctgtcctctatcctcgttttggtacagatttcctgactgctgagcagcctacttgcttgacttctttcatcaataccatgccgcttcccagggtttacataactaggtttgttaattgcacactctgaacattgtacttcactcagccagctcccttttccttgtagagcagtggttaagataatcctttgggatctcacacttctttaggactcagttgaagccataatgcctgctcccaaaatacacgtgaattcaatgcacgtggataggctaagttatgctccagtggccaccactatcaaattctcactcgctggaactgtccgatgtggattgatgggagggatgtgttcttcttagtcactcagtaatccaggctggtggagcttccctcttgaacatgtgcttccatggcatgaaaaagaggtataggatctgacttaacgtttttaaaagatccccctgacttctgtgtagagaatggactgtgaggcagcaagggtggaagcagggaggcctggaaggaggcctggttcagaggacagctgacggtgacttgagccacacagatggcagtggagggggaagaagtagatggattaggatctgttttggagtagagcagacaagattttctgctggattggagatggggagtaaggagaataaaagagtccaggatgacctccaggtttttggcttgaacatctggttagatggcgtccattcttaactagcatcaaaaccacagaatccttgactttgtcaagacatacctgagtgataactgaaaggagcctcagcttggacttcttttagggtgcccttccagctgttttgtaacaatataactggcaggaccgtttttttgtttttcaggcaagctgttcagtaaaggacactcatgcacacccacatgttcacaaacacacactcacacacatcacatgtcacacactgctgtggcagccctttctggacctcacacagcaccattcccgggagtccttcagggtctcttacatggtcctgtcactatttttgtttcttatacaaatcttttgctaatgattctcagtttaaaaacaacaaccatggctgtaccctcaaggagcctcatcctaggaagcagccctcttctgttttgtccctgggagggggtcagcagcaatgagtgacctaggtggtctgaagggccttttatcctatcagagtggtttccagcctagggaaatgtgaaaaccatagtagtagcacacttattaaaccaaatgtgctgctgcaccatcccaagtggcaatctgtggctgttaagtgcaattgctaactaaatgtgtagcctgttgcctaggcagctcatttgaaggagagggggttgtggaaaacgaaataaaatgaaagagtcttggccactgacctggttggttccaggcggagtcggttctgaggtacactctgtagctttagtgtttctagggcctcagggtgggagttcacattagtggtgtaaacaggtactaatgggttccattcagatgctggttgccaaactttctctcagaaaaggccagctgggcagcccttcaggctgtgtgcttgagaggggaagtggaacaaaaggagggccctgaggcagggaggggtgagccttagtacagccaggactgggaagctgcctgttggctaggaaaagcctaggggatttgtgagaggccagaggcttttcataaataggaattagggttctgtggaggggagtgaatctcactcctgcctggaaaaaggaaaaatgtgtgaggtgcctatcttccttcccaccaccattatctgtgtccctcctggaaagtctgaaagccaggtgttgcctatgagtgttttgcggaggtaaaggcacacacaggtaaagttacataaagcttctgtgagataggcatcataagcctatttgacagagggaagatggagctgcagagagagggagtgatttgcccgaggccacacagctaccaagtggctgtgttaggctttgagtcaacctcttgacacttgattaggggatactgcttcctaggcatggtgagaggcaggctgtgctcccgaagcctagagatgggagcaggaggctggttcccctgctctctcctgctctggggcccaccacctgtcagtcagcctgggggcctacgtgaccttcagggttctttccagcccttggagccaaaagctctctgaatctctaggcatgtttcccatccagaaatttaggcagtgggtcagtggatggcctctgaggggcctgccagctctgatgttctgaagacctggaaagagcaaagagcccaatagtttttaatgtgtgatccattgagccctagggaatcccacagaggtgtttcaggggctgccatgagcagttctgattctgtcttttatatattagagatctacagatgatttttgtttgcaagggagtgccacttctaaatacaaacaaagagaaacaaaacagaaactttaaagcccctgaactagatagtgaatgagagacaagtttgaacgaaggtgtctgctgtggtgagagtgatgatggtggtgtgtgtgtgtagtggggggagtttgaactggaaggaaaaagaggaaaatgaaaacaagaggaaagaatgaggttacagtttgggtcagtggtatgggtcagttgccattttgaaaagaggagaaagtagaaaagggaaagggaagcaacagctactgagtgcctacttgtgtgccagtttctctgcttgcatcctcactcataggatgcagacagcaaccccttgagttctaagtattattgttcctattttaaagatgaagaaattcagacccagagagtgaaaataacttttataagatcacatagcaagtaaattgtgttgctaggattcaaaccgagctctttttgacctcaaactctacaccctgtcctgttaggagctctctcctagaagacagttgaggagttacaggtggatgggcatcaagaacacatagtacctttcttcggcagcagcagaggtctgggagtgcttgtggagaacaaaaaggtggagctcatgttctcagtaatttgggaatttgagagagggggctgtagccagggtggagggagaaccaggggagacttaggaagagaaatcagtagttccacaaggctggagagtcaaagcgtcaccaggaagggcctaggtttggacctggaccaaaggacctagaacctcttaggacttgtgtccttgaatggacaggtttggactcttggactatactgtgcatttcagaattgctgtttgcatccagataatcatcacgtttgtagccaagtgttttttgcctcatttgttaatgtaataatattaatataacaaacattcatgaacccaccacccaaatcatgatctagaacattgctaaaaacttacccttactaatatgcttaatattttttggtagtcattttgataaatgattgtctgtcttctcagtatggtggttgtggtttcctatctctaataatgccaaactccaaaggaaagatgtagcttgtgttattggtcaggatgaacaactttgtgccgtgctaaaagacatccccagaatcctagtgggtcatgacaacaaaggtttattctttgcctttgctttatgtctatgatgagttagctgagggctgtgctccttgtctctttaccttacagctccggtgatcagagaacctaccgttgtgaacattgctagtcattatgggaaagggaaagagagccctgtcaggcagcataatggcatagaaatattccagcttggaagtcacatatatttacttctgtgccgttggccagaactcatcatatggttccacccaactgtaatgggccaagaagtgaaatctcaccacgtccctacaaggcacagtgctgggaatatttgggaaacagtgctaatgactatcatagcccacttgcccactgtggtacaacatatgaacatgacttgctcctagctgatgaagttgtggagaaggaagggattgcatgagcagggttgaggaagcccacctgagttttgtccatccctgtgtccctttaggtgataccgttaaggcagcctgccccattatgcaccgattttccagccagagcccccttccccttggaagttcgccattctgctctacctgtttctgtctgtctgtatttcacaggcttcaaggacacagggcatttgaccatagagtctgactagcagctcacttgagatctccttggcgtcttcttctcccatgcatgattgctcagatatccaaggagctgctgctacctcatccagaatggcacttgacttgacagtggtgggattggattttgtgcagagtggtgaagggaggcgagtagggttgggtgagtcatcattgttatttccgttgcattcccatcgatctcacaaagctattaaaagagtcagtaactaagacatagctcgactctggttctaaaagtcaagtgataattgaaattcacattgcaaatcctgcccaggaaatggagtgaagagaatgcactggctcttggccccactgctgggaaggaaggtatgagctgatagctcaggaaacatatccttagcttgagagcacaggacctgttccaggcagctggccccaggatgattcctctgaccactgagtgtatggcttggagaaggcaagtgaacagagagggctttgatatggtttataccgtaaggtgcggagatgagcaaaacagacaatgtccctggtctcacagaaattagagtctagtgggggaagaaaatgattaaacaaatattatagggcatggcaagtgctctgacaaggctgagtacagggtaataaggcaatggcagctaagctggacttggggagccaaggccagcctcctagaggaatagtccttcatctaaacagaggactgaaggataattaggtggtagccaggtgaaggcaggtgggaaggaaggaagttgcagaaagttaggaggtagaggggagtgggagaatcggagcctagagaggcaggcagggactagatcatgaaggaccatgtaagccatgttaaggggcttggacattatcctgaggggagcaggggaccatggaatagttggccattcagatcacacttgcttttcagaaacatcactgtggaagcagtatagaaggtgggttaggaagttgtgacattggaggctgggagtgcaggtgacctgcttaagatatttgtgatggagatgggaaggaatggatgaatctcaggcacatttagaagaaagaatagacagatgtggacagtgaaggaaagtcaggcatcagggatgatgcctaggtttctggcctagacaactggagagcagtgatgggagaataggttggtggttaagcgtagtggctctgaagccaacctgtctggattttgaattccagatctgccactgattggctgtgtgaccttggacaagttccttaacctctctgtgtctcagtttccttacctaaaacgagaatattaacactaccttccttttaatgattaagtgaaataatatatataaaatgctttgaactgtatctggagcatagaaaatgttcgataaatgttagctattataggcaacaaggaagaggaacaggcttcataggaatgatgatgagttcagttctgagcatgtcaaatttaggttgtctgtgggacactcaagtgcaaattggttatatggatctgaggctcaggagatatttggctagaaatataaatttgagagttatcagtttatagatggtaattgagaccttggaagactgtgcagggagaatttgtagagtgggaagaaaagaaggcctaggagcaagacctgagaaccctcaacatttgtggacagaggtaaaagagcctaacgaggaagctgagcagcaaccagagaggagggagaaaaatcaggagagaacacagcatcatagaagccaagctacaagaaagtttcaagatagaggcagtggccaatggttgcagtgctttggagaggtcagtataaaagaagatctgataaacaacaatgggagttagctacgagaaattgttggtgagactagtttcgtggagtggtagaactgtatgtcagactacattgggttgaagagtgggagtgaggaaatggagacagcaagtgtaaacaactctttccagaagtttgtctgtgaaaaggaagggtgagcagatgattgcaggttatgggagaagagagggcatgcttcagtgctgatggagaagaggctgacagtagagagggaaagatgggagacacaggtgagggaggggacaattgaggcttgaagtccctgagatggtgggaggagatggaactcgcagagtgcaggccaggttggaagtgttaatcttggttgggaggagtcataagagggaaggcagaaagtatggatgtggtgagtgaatgtgcagatttggttgtgggaagttgctgcctggtggctttctctctgtgaaattgggtgagggggatgtggcaaggctgggggtttgtagatgatagaagtgctcagagagccactggataaaatggaagagagagcccaatggagacggaaaataaaaagggttgcctagttgtaccagaggcccagtaggttcatagcggttcccagctgcatggttggagtattttcaccaaggagtgcttagcaatcctggagtaggagcagaaagggtagacatttggattgatttaaacatcacttgtggatttgcaagatggatgaaggatgggcaatggagtaagaaaggtgcggatgtcggtaagggagtagttaaaatgattgactcataattctcctactctctgattcagaagcttctgtttctgctgctgcttacaacttctctctattccccactccatagcttctgctcattcaaggctcttatgctcatggcttctgcctcttgtgtatgtgtgtgtgtctgtgtgtctgcttttgccttcattactgactgaagaccctctccctgtctcacattcagaatccacaggaaagactatctgagtgattctatgggtcattgtattcatgtttgactgataggtcaggtcaccccttaggctgctggccaacctatgggttttctgccctgagtcagggatctatgtctggtccagtcagcgtcaacatctttcagaaggttttgtgagtaaaacaagcagaatggttaaggggctctggaacctgatgcctaggcttgaatccaggctgtcccacttattgtgtaaccttgggagatttacttcacctctctgatccccagtttcctcatttctaaaatgggttcagtaagtgtacctgcctcattaaggtatttgtgaaaatgaaataagacagtactaaaaagcacttagcacagtacctggcacatatttatttccctgtaaacattacttattattacaatcattgctattatgattattttactatgaaagcaggcactgggggcctaatagaatttagaaaagacattaggggagatgggatctgaactccatcaccattgaataaacacagtcttctttccttcacaccagctctttaccattttctggtcttctgacctttcctcagggaatgtttgtcaccttgtgggctctaaaggcccaaagcctttggagtactgagtctgccatgagctggggatcgagctgctgggtctgctcattgtcagcttgggaggaatcctggcagcgaggcctctgttgctcagtcctcggtttctatgagtcatgctcctcttatgctaagtccagctcagatttggaagggggctagaggagtgggggtggatgagggaaggaaagggaagaggaaggcagcagtttagcctctttctgagtttcttggttagctccagttatgggaatctttccttagagctctagtgagaggatttgaggccccactgtgaccagactgcaatgtgaggggatccttcacctgcatggtgcagcctaagatgcctgatgtgtgaccaacccctccccaggcaccctgatagtcagggcatcttctctccatctctcttttccttacagcttgatacagatgggtaaagattctttttcccctgaagataatgtaacttgctgatgtaggggaagggaatgtattaagaggcccattgctcagatatcaggctccttgaaatgacctggtccctgatgacttgtgtctgagctgatgttttcctaagggtggtgtttaggtcactagtgaaacatgaaataatttcaggtagtacctggctgaacattttttaactttgatagttatgcatttattttcatgtattttagaagaaaatataactaacatacaaaactggtggtttcaagggtattattgtttaaagccatgtaaagttttagaaaaggaagtttatttaaagaaaaatactaagtgaatagtagtgtaggtgttagacatgtagcaaaagtcatgaaggtagtacacagatgactgaggtttgggaaagagtggtcttaaccaaatgacgttcccttttctgctgcctcttttgccccccacccccagactcaggatgtctgcgttgggaattgtctaatagacatagtaatctgtgtggtcaactgtcatctgaacaggtcaaagtcaaaagccccatctccctttcttgacttcctagtctttgtcgagggctctaatgctctctctctctctctctctctctctgtgtgtgtgtgtgtgtgtgtgtgtgtgtgtgtgtctttcccagcctggtgattggtaatatccctgggatccctccctcttccattttcacactgaatcttgaacaagtcctgttaattcttccttcagagtctctctctccctctccctctcttttttttagagagaggatctcactatgttgcccaggctggattcaaacttctggcctcaagtgatcctcttgcctcaacctctcgagtagctgggactacaggcgcacgccaccatgcccatctcagaatatctcttgcactgtgctccttccaactgtcatcacccgtttgaataccacagcctcagtctatacttcaccatccaattcatcttccttaagcacaactttcaccatgaatttctcctggattggttttccactgagtatcagatcatggccagactcctgaatgagcaattttcagtccttggactatggcttcagcctaacagtatctgcacatatcgcctgtttcccttctaggacccatctaggtctttactattccacagatgtactctgcttacctctagctctagctctgttctatataccttgactaaaatagtttcttcagtcctttccatttggttacttacttattttccgtatattgctttttgtgtttcatttgtgtctctttaagtagactcagcttgctgaggtataggagtgtacttttcatttcttttgtaacctctttggcatttagcaacatgcaaggcatatgggaggtataactgggtatactttggcctgaaagtaacagaaaacccaacttagagtggcttaaacaaatagaggtttattttttgcataacaaaaagtttagagttaggtggttgcctgctctgccatccgtagtgaattggctttcatcctacgcttgttgcctcatggtcacaggtggctgttgcatcttaaggtatcacaactgcattcaagcaggaagaaggagcaaaggttttctgctcagggggctttgtcctgttatttgggaagggagacttccccaggagactgccccttacatttcattatccagaaccctctctccacactcttgagtatagcctgctagagaaaagacccaagttcaagttacaagagtgtggactgagagacttggccaatgcctgcccacctcactctgcttctgtcacatgctccctcttagaccagtgactgatttagaccaatcataattcaagcctgggactgcagttgagttttccctctctgatatgaaagaatctttgccagctacaaattggagttctgttagcaaggaagaaggtgcagaggatggctgtgaggtaggcaaccagcaatgtctaccaaagagctcaataaagaccagtttagagagtaagtggcctgctccggtcctgagtcaggttctaagatttggtaggtctaaggccaggaggtttccagaaagagccatcttctctgtgcccaaacaactgcacctgaatttccctgactgtccattggaaggtcaagctggtcatatgggctttctcggctgtttccctcagccaaaaggaagagcctgtgtagagcatggtgctgtcccatttagttactgctaggtgagtagcttctgcctgtggctctacttcaaggactgaggggagaatgaatggataggcttgcttcttcatggaaaaatcatccctgcccttggagctttggttttcatatgttttctggagtagttctggaattgaatttgcacccaaagaaaaaaatctagaagaggaaatttccaaaatcacattgtgcaaagtgttatttattatagcaagaaatagaaacaacccaaacagccaataatagggatttggctaagcagactgtgagttttagtatattaggctacaatacagccaccaaatgtgactacttcaggaactctgatggtacaaaaatatatatggaataatgttaagtggaaaaggcagaaaaaaatagtaggtacatactggctgtgtaaaatgtacatgtgtgctttgaaaaagatcagaagacagttgtccagtttgaaatcaaagaggaattaggcaaccaagatgtattttttgaaattgaatgccaactctgaggcagttgggggggtcatccgttggggagtccagttcagctgaagtttaaaaagtgggagttagggcatccaatactattccttctttcaccatgaagacggaaaggttaagatagagcttgaacttgaacttgggtcttttctctagcaggctacgttccaaatgtggaaagagagacttggcctctgtgggcccacctcactctgcctcactgctgagaagtcccctttcttctgtctcgcagctgacgaagcattctgttggaagactacacttccattccagaacagtgtgcgttactgtgtggagacccagtgtgagttccttcctgaggtttcttggcactggctgtgctcctgcgtccccccaccccgcaacccctgccgttcatcatccaaggtttacactgtaaatatctgaatggggtgaaaagaaaaaccagacctccgacttggggctggtctgctggaggctgagccaagggtgtgttgttgatatagaagatagttctctcctaagagtttactgaaggagattatttttgctggttcaggttttccaactttattcaagagcctgaagacaggagggaagcaggatgggtgtgtatatgggctagcagggaagagagacttgtttttctcttttttcctgaccagttgctgcccagcaatagctgccatttattgagcgcttactgtgtgctgtgtgctttacacatgccatcttgtttaaccctcacaagagctttgccaagtattacccccacacacactttacctttggggaaacaggctcagaggggacttagccagagtaacttacccagggaataatgaaatcaggatttgctcaacaaaaatgtattgagccacctactccaagacaagcctcaggctgacataccggctgtgcggctgtgaataagatcggctcattgtcttcagcaacttgtacccataagggtgggtgtgacagataagcaggcagtgataggacagggtagtgcctgttctgatggggaagagcctagtgccatgggaggacagagaagggggaacccatcacagacaggagcaggaggcagggagtcagcaaaggctttccagagaaagtgatgagctgtatggatctggagaaagagtacaagtcagcccagtgaaggagatggccaataagcaattcaggcagagggcatagcctgcctgttgattaagtattcaagaattttgcaagctggttatcagaccattggtcacttcaaattgggtcatgatggaagtgtttatagcaaggaagggagttgggagttctcagctatagatgtgaatgggattaccgtggcaggctatacagagtgccaggccgaggaccaagccttggtaaatgctaagaggcaggcagagaaagatgagctcacacaggagactgacagggagcggtcgtctggctccactttcacaaccatctcatcatttccaactctgttaccactgcctttcttgaagcccatatcatcttatatctggactatctagtcagatagtctttacaacttatctcctggtttctcaagtctttttaaaagttccttatagcttttctgctaactgggtaactgggtaagtaaaataatctggttggagcagacagcttatatagaagagtatggattttagcatgttcactcctaccacttgctggctatgtgaacttgggcaagtttcctggtttttctgaacctcaatttcttcatctgtaaaatgggactagtacttccttctgctgccagggctctgagaatccatggagactacacatgtgataaagggcccagcacagggcctggttcaccattggccagtggagaggtcgccaaagattttcccatatggtagctggtatccacaggaaggctcattgaggactctgcaaacctccatcctcagctgcgcaccctctacctgggcactccagcttctctcacttcccttgtctgctgctcctgcccctctcctcccttccattctggcaaaattgaacaatggccccttcctctaccctccctgcctcatgctcaacctgttcacactccaggagcctgaagaattcctgttcctcaccagcccatcagggcttccctctcctcactccagctgatccttgactcttggctcctcctagaaacgtccttgggccatgggcctccgttcctaacctcgtcctgcagatgtactaactttagttcccggaaccggattgaaaggactagaatgaaccgcatcaaatgttaaggaacacaattcaagaacgctgcagcacttttcatgtgctatacaacagattgtgctgaggctggggggcatagatgcttgttggcagcagggttgttttccaaatcactccctgatgctttgaagaggaaaaggaagtaagttaggagactagtattcattgaatgcctcctgggtgtctggccttatgctagggtgcttcataaattgtgtcattcattgtcacaacaaccttgtgagatgatgatgttattcaagttgtctgtagtgtccctgcttccctgtgagctctgtgaggatatggaacacactgtcttcgacactgcatctggcaacctggatggagttggagaccattattctaagtgaagtaactcaggaatggaaagccaaacgtcgtatattctcactcataagtggaagctaagctatgaggatgcaaaggcatagaatgacacaatggactttggggattcggaggaaagggtgggaggtgggtgagggataaaagactacatactggatgcagtgtacactgctctggtgatgggtgcaccaaaatctcagaaatcaccacaaaagaacttattcatataaccaaacaccacctgttccccaaaaacctatggaaataaaaaaagaaagaaaatggccattaaataaaataaaaagcaaaagagatccaagagagaaaaataaaaataaaataaaataaaataacaggtgtcaacacacctaaaaagaagaagaacatggagtctgtgctcaataaataccggttgaattgaattgctgacactgttgtgttgaggcagtttggcccaggcaggcaaataagcccaggatttgcagtcttggcctgtgtggctttgggcaagctatttcatttttctgagcctcagtttcttcatgtgtaaaatgggaataatgacacctatatcccaggggttgtgagcatgtgcaagtggtttggtaaactccaagtgctgcccaaattagtgtgtggggtgcatcacatgcgctctaagctaggcttttagttatccaattatcatctaggtctgcagttcccaaatgcaaatcagcactcatccttcgtaaagtttttactcttctgaattaaaaaatgatgatgtaggccaggcacggtggctcacgcctgtaatcccagcactttgggaggccgaggtgggtggatcacgaggtcagaagttcgagaccagcctgaccaatatggtgaaaccccgtctgtactaaaactacaaaaattagtcgggcatggaggcacgcacctgtagtcccagctactcgggaggctgaggcagaagaatcgcttgaacctgggaggtggaggttgcagtgagccgagatcatgccactgcactccagcctgggcgacacagcaagactctgtcaaaaaaaaaaaaaatgtagttttgtttttttttttttgagacaagttctctgtcacacaggctgaagtgcagtggcatgatcatggccactaatttttgtactttttttttgtagagatggggtttcgccatgttgcccaggctggtctcaaattcctgagctcaagtagtcctcccacctcggcctctcaaagtgctgggattacaagcatgagccaccgtgcccggccgatgtagtttttatgaagccaaatttgttcagttttttaaattctaaaattgtcattccaattgtttgatgttaaaacatcattttgttgtttatgacatcttggttttagtatatggcagtttttaaaattaaaaaatgctcttacttgatcaaataaaatgttggcacagctatgccagatcccccaacaagaaaagtagcatagaggggctgatagagaggaacctgggctgggcgtgggtgagaaggcatttgaggtgggcttcctgaaggcaagggggcctgaggagagttaagaagggtgaataggagaacattcagcaacaaagggtgggaaagacacaagctggagagctgggccaggatgagtccagacaacctctagaaatctgtgaagtctgggccgccacccagcaggtgagcacctctgagcttccctgtggagtgttagggtcggggagtgagccgatttgtcccagacccgcctggctcacacacggggatgaaaaagtccaggtcactgcattggacagccactgagctcccccaccacagcccaaaggggtgccttgcggtccgtccaggcaattgctgccacactctgcatcaaacccccaactccccgtctgactttgcctatcctccacctcctctcctactctggcagcttcagtaaagcaggaatcactcagctctgtgtgtgggaaagcacagagcccacagcgcaaacatacaggctcatcggaaactcgaaatcccccctctgccttccacataccaagccacacacaaggagtggcagtggggtagaggctggttcctttctccagaatgccacagggctggcctgaggttgtggtgggggaagcacttccccctggccagctgtatgacctctggattccccagaccacacggttggcagcaggaggcccctggcggctgggagcgccagacccatccgctggggcagagagtatgaccacctgagcatgcgctttcgcattccaagtggtgggtctggattatccatttcttggttttctccagacctctgctccatccatcagagtatttttttttccacctggaatcctttggccagtgggtgcagccataagtttgtccagccaggggcatacgccaggtgcctgccgagctgtccatctggcccaggcaagaggcaaaggataacttccagaaaaagagaaagcccatgagggcagggcagaaggcaaggctaaggagtggaagtaacagtcccaatgcccagcccaaagacctaagcctggccaacaatactcggcaggcatccctcgctccctgtttagggcaggttgccatggtattttgcctgctggtgcactgggactggaaaaaaagcagagtgagcctgagggtggaggattgggaggatggttaataatgggaggagagctggactttttgccccagttctagctggagtttgcttcagcagcagagtattgtggctgtttcagggagaagcccttgtgcctttatgaccccagggattcctgctgctataagtgcccaagaatggcatatgccttacaagctgcccaagggccgggcatctatgccatggctctgctcccacttgtgacatggtgggtctttcttatggcttgtaaactctccccatccctgtggctggacttagacagctctgtttatcattctcacactgaaccaactagccatttctgtgggtgggtgtcagtcacaccctactgatttctggtatatcctgacattgagtagcagcctgtagctgtgatggggagaaaggttaatgctcattttgacagaagcattagagttaagtccaaactcccgggcttggcattcaaagacttcaacaattaatcttctataatgctcaacattccaatgccacatatttggaccccaaaatacaaaatacacacacacacacacacacacacacacacacacaaatacctggcatcatgttgaaaaaaaatagtggatagaaccttttcagttttcatttgtgtgtttgccatctcacagttacaggtatggtgtcaaattttatttgcaaattgacaatctccaactctgtgtgtctaaatatatttggattatcagtacttgatatagtgattggtgtctctgtgtttatgtgtccaagtcttacctgcactgacaggccaggcaaactaatttgttctccctaagattttagacataaagctaacataaagctttgctataagaaataggttgaggagaatcagccaagtccctgctttcaattcttctggatatatatccagaggtagaattgctggattatatggtaatcctgtgtttaattttttcaggaactgccatactgttttccctactggctgcaccattttgcattcccatcaacaatgcataagggcccaatttctctgcatcctaaccaacatttgttatttcttgtgtttctggtaatgtccagcctattgggtgcaaggtggtatcttgtggttttgctttgcatttccctaatgactagtgatgttgagcctcttttcatgtggcaggcatgtaagtttttgacctgttgatgaaactgcgcatttagtcttgttttccaaacactcttggacactggatatggccattgttttataggttagaatgacctttacttaaagaatgctttgttgtgcagttacctctggactctccacatgctttgaaggctgcaaccttacagccagtcagccctgtggcttctctatactctctgcccctcactgtagacttggctttccataagccctaagatttcttcgattctctgttttctgttgtatttaacccttatagtcccaccctgctgtgatagccagccagccatcctgaagaggaaaagattcagggaatggagaagaggggaaaaggaaggaggtgacagatttctctgaacccattatctggtcaaaagagtaagtgaatctggtcctccttctatgcaaaaacaaaaccaaaaacaccctattttgtctgtctatcaagcagttctatgccttcttagaaacttgcctattctccaatatgggttgaagtatagaaaatgtagctatgagagggcaagtgtcaaaatgcctggatttgtcactaaaaatgctatctagggatttcctttactgattgatctcttagtgagtgtaaagagccagtgaacctcatggaaaacaaaagtaagaacaaaaaggaagcccctccaagttcttagcattacagtaggagtgtttacagttggagaagggatgctgtcttagtcagcttgggcagctataacaaaatgccatagactaggtaatttataatgaatagaaacttatttttcacagatctggaggctggaaagtccaagataaggcgccagcaaatttggtgtctgatgagtacctgttcctcatagatagcaccttctacgtgtcctcatgtgggagaaggggtaaacaggctcccttccctcaagcttcttctataagggtactaatcccattcatgagagctgagccctcatgacctaatcatctcctaaaggcctcacctcttaatactatcacattgggtattgggttccaacatacgaattttggggggctaccaatgttcagagcatagcagacacgtgtcttcagtttcaccttcctgttggggtcctctccctgatccccactgtccacactataccaggtggcctgggttaacccacctggggaccagatccacattcttctcctttggactcctgagatatcttgcattctcatcaggaaatttgtcaaatactacaggacagcaaggaggaaatcattgcaaaaattacaatgaacagcatattaaataggcaggtttcctgagtgtaagttttgggtccaacagtgaatgcagtctgaaccaccaagagccagggcatcgtggctggtcccttgcctgacgtccttctggcccagctcccagcctgtctctggggagtgggtgccatctaactctccactgtctaggagaagtttccaggataagaccagaagagaccatattccaaattagctgttcatttgggccctctggctctaaacctggatccctgtttgggaagtagctgtgcctccctgtatacatcctcaaggcaaatggtcttgttttctagagctggcttcccaaggtagacctgtgtcccccagagagtgggagtccatctcgtgcttttggatgggacacgaattagtattatgtttttaatagcaatgtgtttactttcgtagtttccttctatttaagtcatgtggtagtggttttccatttacatcaatgagtcacagattttttaagtaaaagagtaagaaattgaaaaaaaattaactaaataatagttaagggggtatgtggatgtgacaaaaattgtgaaggtagcccccaagtgactgaagattgggacatacttccttagagtgacttgcctctctaaaaataaccttttaagagacagttgccaggaggactgtgtgaaagaattaccaactttgggttccagggatctttccctttctggatctctgatgctctctggtgagagcaaggaaagcctagaatataattttctctcccctttgaatagttctactaataggctcctctgtgagcacagataaaggggccattgaccatattttatttcttcattagcttcctgtaatgctttccttgctgaaattcaaggcagaaatggtgtgcctaaacctcagattactcttcttcagaagaatctcttcagctcaatagtttaccttctatccccagcctgcaccttcgagaaagaggatttttcaaatcttttctcgttttgctcctcactctcccagcacatattttccagaagcattacatgggaagcattcataaacattttttgcactgaagaaatctgcactaagcttgacttctgcttataaaactactccttgctccattatgttacaggcattccctggggggctgtccctggcatgctaggaagggactgaggcatctggcgtttatctagtccctgagccaggcactacatgagccaggagctacactaggccttctatttgtttgaattctggctgaattctcaaaccagcccagtaggtgtcatttgacatctgaggaaactgagctcagagaagctcagtaacttgcccaccatcacacagcaaggaaggggcagaagccaggaggacttgcccccggtttcctgactctcatgcactgtgcactgcctctgtgggggcttgctcttttctgcctggcgtgtgctgctgcgctgctgtttggacaactagcaaaaggtctcaacacaggggctttctcttttgcctgcaacaacaatgagctcaaggggaaaacagattgattaaagctgattttgccctagtgagaaactggccagagcatctctggagggcctcgggctgggcccagttggctgtcaggatgtggcctggagcctcacttcccttcctggctctccctttatcttctacactctcccattgccttctgcgccctgaccctgctgcccttccatgggagctgaaaagcaagctgctcagaaggaaatggcttttgttatttaacctgaataagtgtcaccatgtgccttctctggaaatctactcatggctgaagagggggaccagggttaccctagtgtcctttgttttgttaggggcctaaagcagaagcaaaggcaaccctcatgtataccactgcttttgtccccacttcctttccaaacactgatcttaaccctattcccctaaaacatagctgataaatgataaatattcaggcccttgcctggcattgcaagctacaaacaagctggtctcaagcagcctttccagtcttgtgacccaccacttccttatacaatcctcactttcctggtggccagaatacccaccatgccctaaacgctcctggctttctggcctccttgttcctcccacctctgcctattaagcaacttcgtgaagtaggaacgagctcacatccgaagcgccggagagagtggcatgcctaccagcctcatcttctatgtgcttcagtttccttctctctcgaatgtgcctgatggtgtagcccacttaccttgtcaaatggttgtgatgagattgaatgctatgaaaaacccttagtaaaatgtgaaacaccatccaaatgctgttttgtattggtaaaggaaaatgacccatcctttagggctcagctcaatggcacctcccccgtgaagtctcccctgattccctggagagagtgatcactctctctttgtgcagtgctgtagcacttggtggttcttggtggtatgcatcactttttgcccagcacgagagttatttgtgtccaagtttgcctattctgtcttcaaggccgggagtttatgtggagggcagagaagtgcttaggcatctttgtttcccactaggcctagcccacacgtctcaaaaagcacttattgaactggggaggcaaaaaacaaagtcaattctttgacctggaagctcatctgagtccatgtatgtctcctctgggagctgtgagaggagggaaaatgacagaggatggggtggggagggtaggatggctgtagagggaagtgatgggaagctttcgaatgacttaaattgacttttttttttttttagttttcattcaattctgaccacatgtttcccatgaatccttagggagaaggaagtcagaaagttagtccttcgcctctccctggctcgccctggagtaccacatggatgagccaaagagcaggacagcctgaggaacttgcctcgtgggcctcacgctctgtagcaactcagaggcagagagaagctcctgggaggccccatatgtgacagcttctaaggaagctgcttgtggtgcatccatgaaacagggtggaacaactgctgattttgaacaacaaagctacttggaggccacattagactcagaccctgctcaacatttgggttctccccaccccgctcttcttttacattattgaggtaaaattggcattcactaaatggcacatatttgaagtatacaggttgatgagtttgatcatatgtatgcacctgtgaaaccattactacaatcaagataatgaatatttccatcacccctaaaagtttccccttattgatcacctttaatctttcttcatagcctaagtaagggaagaacatggttttattgttgatgggttattcttatgttagaaaactatcaggagcagtggccttggggacctgagtccaacttaaccctctgtgagcctcagtttgtccatcaataaaatgggatagttggacaaaaaaattgctaaggtttcctgtcagtctgagtgacaggacctttctatgatacaacctttctaaacagcaatttttaaaaaacataaaagaagtgtaatctactttgctttctcatgcccccaagttacattctggcagggtcatggctgatggtcagagtgatgtcgggttctgagggttctgggtggattattaactacattttacagatgagaaaacaggctaagaaagaagagaagatcggctcaaagttacacagccaacacgtaactgagctgggatgcaaatccagcagtgactcctaatctaatgttctttgcactgccccacactccattcccaagaatacaggcctagttccatgttgctgtcatgactaagggtccttgcatccaacagatagttctactttcctcctggtttaatctggggaccatagttcacctcctcagatctctggtaggtaaggaggcaagagaggaggctcccctgccctcctaaatcagaccaaatcaggccacagaacaggagtcttaagttttcttagactggaggtttccagaaagcagacgctctctgggcatgtaattcattgtattcagcctcctagtaccaggtacggacaaatgttcagtaaaccccatggcgggaacacaaggtcagcaggacaggatagaaatcttgggattaggagggacctctacctggcactttgcctcatgtttgccctggggtacaatcccccaaggggacctgttatgggctggggttggggcagtgctgggctgagctgagttgcacacagtcattatggtgtgagcacgtgccccaacagtgcagtggcacgatctcggctcactgcgagctccgcctcccgggttcacgccattctcctgcctcagcctcctgagtagctgggactacaggtgcccaccaccgtgctcagctaattttttgtatttttagtagagatggggtttcaccgtgttagccaggatggtctcgatctcctgacctcgtgatccgcctgacttggcctcccaaagtgctgggattacaggtgtgagccacaacagctgcatcttttataactccctggaggaagggaggggggccagttactttccctgccctttttttcagacccccagtcggcctactgtgcctcagcgtaaggtaggaaagagtgcctccatggggaatttgtggtggtagcagggttctgagcagacccagggtgtttactccctgagtactcaggaagtacccagagtaggtgctcagtaaatatctgctgactgactgaatgaactctaactccatgtcaagcactgtagggggtacaacgatgaattggcctccatccctgactgtagcagagaaagagggataagacaagcacataaataactgttacacacgacagaatgtgataaatgccttgggagatgaacagccaattgctcaaagagcttggaggagggacgctcacatctggcaatggtggggggaagggactctagagaaaacttcctgcttgaggtgacattcgagctggttttgaatagggacggggtttctacagtggctcaggaatgtttgtgtggtgggggtggggagtcaaggcaggctgcattccaggccccagcagcagacttagggccagaagtctcccttagtatatcctcagagagcacagagaactgcaaatcagtgatagtcctagagcctcactataactgcgtgttttcaacctccatcccaccatgccttgatttgagaccccctacaagtggccaaatggacttagctgggctgcttgctggctcatgggctagctagcccaaaccagaagtgagagccagtcctggtggccttgcagacatttcctcatgaaagcctttcttcccagctcagctcttatctgggaacaataaaggtcctcaactctgggagaaggccatgcagggaacaatagtttctggctcacttcatccatcattcatgtggctcagatagaccattgctgagcagcagtggggacgagttgggggagggggagggcacattattttgcatgagattgttcattgggctgccccaaaactacacagtggggaattgggtagcgacattcctgggtgtgctatacataggcatgagcctgggcatataatccagccctttctcttctctctgcctctttgtttcctaatttctgtccagaggcagttggttgctgttaactggtaaactgaatggtttcactggacatgggacaagatattggattcatttcagcagatattttcaaatatattatctcattgaatcttcaaaacaattttataagttggaattattattttcactttacagatgaggaaactgagggccagagaagttaagcaactgccaaggatgcagataggaaggtgaaattggatatcaggactcctaactgcaagtgacctcagctgtacagtctgaaggctggcagttacaaattagttgcaaacgatccagggactgaacaaaggagaaaaaaggggaaatgcgagagttaggcagctaccagttaggcaacctattctccttgtgccaccatgaagaataagttgatcaagggtggaaaagaaaactcagggcttcaattccagtatggaggggtctagaagtctccagaggataggaaagaggatggagatggagcccccactcatctggctcttgcctgcccagggtgctacagcgatgcagccacagcctgtcggctctgttcacctctttaaggttgatgtcagccaaaggcagcccccagagagggaccacttatcctgaacaaatttatcgtatgaatatttgttaatgtatacaacagtaagagtcttactagtatatttctgaaacagatttataccaaaaattagtctggttttaattaaagtattttaacagctttttaaaaaagatgtaatttaaataccacaaagttcacccatttaaagtgtacaatttaatggtttttattatatttaaagaattgtgcaatcatcactacaatcaattttaaagattttcagcttcaaacccccaaatcaatattgtaccctcaagctgtgaccccccaatccctcagcctctcttactcctccactccccagtactaggaaacgtctaatctactttttgtctctagagatttacctactctggacatttcatataaacgatattatatgtcttctttttaaaatagcttcttttacttaacatacggttttttgagatttatccatgttgtaagatgtatcaatatatcattctcttttttttgtggaaagatattcaattatatggatataccatgttttgtttacccattcatcagttgatagacctttacattgacaagtatttttgcggagcctaggagtggaatttctgggtcatatgctaactctatgtttaaccttttgaggaactgccagactgttttccaaagtggctataccatctctccacatcctcatcaatacttgttctgcaatgttgtcttgcttataaccatcccagtgagtgtgaagtggtatctcattatacttttaatttgcatttccttaatgactcatgatgttaaacatcttttgatgtgttagttggcactttgtatattttctttggagaaatatcttttcaaatcctttgcccatttgtaattgggtgatttgtctttttattgttgagttataattattcttgatatattctggatactaggcccttatcagatatctgatttacaaatattttctcccattctgagttgtcctttcactctcttgatattatctactaatgctcaaaagtttttaatttttatgaagtcaaatttatagctactatgtatttcttttgttgcttatgctttttacttcttttgttgcttatgcttttggtattatatctaagaaagcattgccaaatccaagatcatgatgattgactcctatattttcttctaagaaatttattggtttagttcttacgttttggtctttgatccatttctcttttattagggtaggaatccaactttatccttttgcatgtggctatccagttgtcccagcaccatttgttgaagagactgttcttttcccattgaatggtgttgacactcttgtagaaaatcaattttctgtagatgcatgggtttatttcttcactgtccaatttattccatttgtttatgtctttctttatgccagtaccatatggttttgattactgtagctttgtagtataactagaaatctggaagtgtgtgtcttccaactgtgctcttcttttctaagagtaatttgtctatttggggtctgttggaagaccatgtgaattttagaattggctcttccatttatgcaaaaagggatattgggattttaatgggaattgcattaaatttgtagattgttttcggtagtattgacatcttaacaatactaagtcttccagtccatgaacttagactgtatttctgtttatttatttaggcttctttaatttatttcagcattgttttgtaattttcagtgtatgaatcttgtacctccttggttaaacttattcataagtattttattctttttgatgctattgtaagtggaattgttttcttaatgtcatttttgattgtttattgataatgtatagaagtacaactgattttaacatattgatcttgtaccctgcaactttgctgaattcatttattagctcaatagtttttctaggattttgtatatataagatcatgtcatatgtgaatagagatagttttactatttcttccttaactatgtgaatgaatttttccttccttctgttcttctttcctttcttctgtactttcttcctccctccctccctccctctctccctcccttcctcccttccttcctcccgccctcccttcctttctttattccttgtttttcatttattttatttttgcctgaatgctctgtctagacgttccaatacagtattgaatagaagtgtcaagagagggcatccttgttttgttcctgatttaaggaggaaagctttcagtcttttaccattgaatacgatgttagctttgggtaggtttttattttatgcctcttaccgtgttttttgtttgatttttgtttttgagacagaggctcactatgttgcccaggctggagtgcggtgccacgatgatctcagctcactacaacctccgcctcctgagttcaagcgattctcatgcctctgcctcccgagtagctgagattacaggcatgcaccaccatgtccagctaatttttgtatttttagtagagacaagattttgccatggtggccaggctggtctcgaactcctggccttaagtgatctgcctgcctcagccttccaaaatgctgggattacaggcatgagccagtgtgcccggccatttatcctgttttgaaaattcccttgttttcctcatttgctgagtgttttattatgaaaggtgtgaattttgttttttgtttgttttgcttcattttcaaatgatcatgtggtctttttcctttattttattaatatgacatatttcagtgattgattttcatatgttaaaccacccttactttcctgggataaatcctaattggccatggcatatattcttttaatatgctgctattgaattcagcctgctaattttttcttgagaatttttacatttatataagggatattgatctgtagttccttttcttgtgatatctttggctttgatatcagggcaatgctgccctcagagaataagttaggaagtgttccctcctcttcaatattctgaagagtttcagaagaattggtatcaattattccttagatattttgtagaattcaccagtgtagccatctgatcttggacttttctttattgggagatttttttattactgattcaatgtctttatttgttataggtctattcagattttctatatcttgagttcattttggtagtgtttttgtttctaggaacttggttctcttataatttttttaaaatttctgtaaggttggtagcaatgtccccactttcatctctttccttttttttttttttttttttgagaccagatctcactctgtcacccaagctagagtgcagtgacaccatgatagctcactgcacactcgatctcttgggcttagacagtcttgttgcctcagtcttctgagtagctgggactacaggcatgtgccactatgcctggctaattttttttttatttaattttttgtagagaccaggtcttgctatgttgctgaggctggtctctaactcctggcctcaagtgatcctcctgcctcagcctctcaaagcattgggattacaagcatgagccaccatgcccatcccctacttgcatttctgattttagtaacttgtgtcttctctttttttttccttggtcagtctagctagagatttgtcaattttgttaatcttgtcaaataaccaactgtcaagtcattgatttcctccatttttttctattctctacttcatttacctctactctttgttacttccttccttctgctagttttgagtttagtttcctcttatttttctggcgtcttgaggtgtaaagttgatcttctccctggttctgtccattattgaaagtggtaaattaatctgtttatggtaagccctagagcaacagttaatatgtaaataatatagtaaaatatttatttttattattcaaaataattttaaaaatcaaagtgctatgatagaaaacattcacttaatgcaaggaaagcataaaggaggaatagagaataaaaagctatgagacatataaaaacaaaaaataaaatggcaaatgtaaactcaattatatcaatagtaatcatgatattaaatataaatgaattaaacaatccaatcaagaggtagagattgtcacacaggatccaaaaaacagtgtaacagtataactacatgctgtctctaggagacactctttaaattcaaagatacaaatagattgaaagtaaaaggatggaaaaagatatgtcatgcaaacagcaacctcaagaaaggtggaatggaccaggtgcagtggctcacacttgcaattccagcactttgggaggccgaggtgggaggatcacttgaaaccaggagtttgagaccaacttgggcaacatggggagaccccagctctacaaaaaataaaaaattagccaggcatggttgcacactcctatagtccaagctatttgggaggctgaggtaggaggatcacttgagcccagaaggttgaggctgcagtgagccatgatcatgccactgcactctagcctgggcaacagagtgagaccttgtctctaaaaagaaagagaaaggtggagtggctatatatatacacatatatatatacatatatatatatatatatgtatatacatatatatatgtatatatatatatgtgtatatatatatatatgtatatatatatatgtgtatatatatattattattattatactttaagttctgggttacatgtgcagaacatgcagttttgttacataggtatacacatgccatggtggtttgctgcacccatcaacccatcacctacattagttatttctcctaatgttatccctcccctagccccccacccccaacaggccctggtgtgtgatgttcccctccctgtgtccatgtgttctcattgttcaactcccacttatgagtgggaacatgcagtgtttggttttctgatcttgtgatagtttgctgagaatgatggtttccagcttcatccatgtccctgcaaaggacatgaactcatccttttttatggctgcatagtattccatggtgtatatgtgccacattttcttaaaacccaaaatcctgtgttttgacagggctctctttgactgaacacagccagctgttaaaccccactaattgctggctgattgttctattgttttcaaaaatccttaagggcctaaattgttccaaaaactggtccaatcaaattctggcacctttgaagcatagttccctagatcagtatttgagatttgttctgataccaggagggctcttctcagctgtctcttctctgtttctctccagtgaactagccagcttacagttaagcctgtatctccaatgaatatattattctcctaccaattaccttttgccacagtctccactgtttttgagaacatctccaaactcttacatctttcattctcttgatggtgtctttcacagaacagaatttttaattttaatgagtccagtttattaactattttttttcatggattgtgcctttggtgttgtatctaaaaagtcattgcaatgtaagttcataaattttaacaaatgtaccactctggtgcaggatgttgatagtggaggagattggttgcatgtatatggagacagggagtgtaggaggtatatggaaactctgtactttctactcaatttttctatgaacctaaaactgctctaaaaaaattttattaatttaagaaaagtttaaatccctagatgaagataaggtgtcaaaattacaaatagactaataatcgaagttttcaaaaagccatcaccatacaccaggtcatttacatgttctctctcgtgttattgtctgggagttttatagttttgcattttacatttaggtctgtgatccattttgagttaacttttgtaaagagtataaagtcaatgtctagatctatttcttttgcatgtggatgtccacttgctcctgcaacatttgttgaaaagactatttttgctccattgttttacctttgctattttgtcaaagatcagttgagtatatgagagtatatttctgtgccttttattctgttccattgatctacttgtctgttcatttaccaataacacactgttttgattcctgcagctttatagtaagtctcaaggttgggcagtgtaagtccttcaactcttcttctccttcaatattgaggcggttattccatgtcttttacctctccatataaactttagaatcagtttgttgatatccacaaaataacttgctgggattttgattggaattgtattgaatccatagatcaagttgggaagaactgacatcttgacaatgttgagttttactattcatgaacgtagactatctccccatttatttagttatttgatttctttcatcatagttttgtagttttcctcacacagatcttgtacagatgatattagatttataccaaaatatttcattttctgtgaatgctaatataaacagtaatttttaaaaacactttattgatgtatgacatacaaaaagctgtgcatatttaatacacgcaacttgatgagtttgagataaatatacaccaaacatatggaatgcttcgcaaatttgcatgtcatccttgcacagaggccatgctaatcttctctgtattgtttcaattttagtatatgtgctactgaagcaaacataatactaatgaatttttaatttcaaattccacttgttcattgctggtatatagcaccgcaattgactttgtatattaaccttgtgtcctgcaaccttgtataattgcttattagttctaggagtttatttattgattctttcagattttctgcatagatgatcatgtcatctgtgaacacagacagttttatttcttccttcccaatctatttaccttttatttctcattgcattacctaggccttccagtaaaatgttgagaagcaagtggtgagaggggacatccttgccttgttctttgggaaagtttcaaatttctcaccattaagtatgatgttagccataggttttgtgtagatgctctttataaagttgaggatatcctttctatttctagtttgctaagagtttttatcatgaatgagtgctggcatttttgtcaaaagctttttctgcatctatagatacaatcgctatttttctttactagcctattgatgtgattgattacattatttgattcttgaatcttgaaccagcctttcatgcctggggtaaatcccacttggttgtgatgtataattatttttatacattgctggattcaatttgctaatattttgtcgaggatttttgcatctatatttatgagaaatattggtctgtggttttcttttctcgttatgacttcatctgattttggtctttgggtaatgctggcttcacagaatgagttaggaagtgttccttctgcttctatcttctaaaccagattgtagagaattggtataaattttccttaaatgtttgacagatttcaccagtgaacccatctgaacttggtgctttctgttttgaaaggttattaattactgatttaatttatttaatagatatatgactattcagattatcaatttctttttgtgtaagctttggcaaactgtgtcattcaaggaattggttcatttcatctagtctattgaatttgtgggcatagagttgttctttgtattcttttattattcttttggtgtccatggaatttgtactgatgttcccccctctttcatttgtaatattagtcatttgtgttctctttttttcttagcctagctagaggcttattgattttattgatcttttaaaagaagcagcttttggttttgttgattttttctccaatgattttctgcttttggtttcattgatttctgccctaatttttatttcttttcttctgcttactttgggtttagttcgctttttcttctattttccaaaggtggaagcttaggtttttcttcttttctaatatatacattcttcatttctaatatgtacatgctataaatttccttctaagcactgcttttgctgcatccctcaaattttgatatattttcattttcatttagttcaatatattttgtatttctcttgagattttttctttgatccatgttttatttagaaatatattgtttaatctccaagtatttcaggattttctagacgtctttctgttattgatttctatttcaattccattgtagtctgagagcagacattatatgattgctattcctttaaacttgtaaaagtgtgttttatggcccataaaaaagtattaactgttgtcagatttatcctcactgagcatccaacaattcatcaattacaattcaggttttcctactccagtactgatttctgttcatgagtttctcttcccatgagttgtgattctctgtgttcatctgtctgtctctaattttgagggcagaggtttgccctgtgacctcatttctctgattaatctaagaagaggtattgatttttcagtgtgttcagctttttacttgttaggatggggagcgacttctaagctgcgtgcatgttaaccggaagtcaatctttttttttttttttaagagacagggtctctgccccattgtccaggctggagtgcagtggtacaatcatagctcattgtaacctcatattcttgggctcaagcaatgttcctgcctcagcctccctagtatctgggaccacaggcacacaccaccatgcctggctaatttatttaattttttgtagagatgggggtcttactatgttgcacaggctggtctggaactcctggcctcaagcagtcctcctaccttggcctcccaaagtgctgggatgacaaagagcagtggcatgagccactgctcttcacactgtcatgcttgaagtggaacctgccacttcatttcatactgctgaataatattccattccatcttatagctataccacattttatttatccatttactagttgatacacatttgtgctgtttctactttttggatattatgaataatgctgcaataaatatttatgtaatgtgagctctttctgcccttttttgtatggcatcctttgatgcacaaaaatttttcaccttgattaagtttaacttgtcaatctttttttttgcttgtgtttttggtgtcatatgtaggaaatcattgcctaacccaatatcatgcagattttcttccatgttttattctaagagttttatagttttagcttttacatttagtctataatcttctttaatttttgtgtataatctcagatagaggtcctactttattcctttgcatgtggctatccagttgttcagaattatttgttaaaaagacttttctttccccatttaattatcttgatatctttgtcaaaaatcagttgaccataattttagggtttctttatcatctcttgcttattcagttgatctaaatatctagtcttgtgctagcaccatgcagtcttgattattgtagctttgtggtaagttttgatattggaaagtataaatcccccaagtttgctgttctttttcaagaacattttggctattctgagcccctttcatttccatatggattgtaggatcagcttgtcaacttctgccaaaaaagatagctgggattttcacagggattgtgttgaatctgtagataaatttgggccatgtagctatcttaacaatattaaattttctgatatatgaacatgagatgttttcccatttatttatatcttttaagattttttcaaccatgttttctagttttcgaagtaagaaatttttacttcttttgttaaatttatccctcctttttttttatgcttttgtaagttgaacggttttctttttttcttttttttttttctttttttttttttgagacagtctcgctctgttgcccaggctggagtgcaatggcgcaatcttggttcactgcaacctccaccgcctgggttcaagcgattctcctgcttcagcctccccagtagctgggattacaggcacccaccactgcgcatggctaatttttgtatttttagtagagacggggtttccccatgttggccaggctggtttcgaactcctgacctcaggtgatccactcgcttcagcctctcaaagtgctgggattacaggcgtgagccatcacgtccggccaaatggttttcttaatttcatttagcaaacttgttgaatttgtttattaattctcatagatttttagtggtttccttaggattttctatatacaaggtcatattatctacaaatagagatagttttacttcttcctttttaatctgtatgccttttgtttctttttctttttaaactaattgctctagctagaacctccattacaatgctgaacagaggtagtgagaacaaacacccttgtcttagggaaaagctttctgtttttcaccattaagtatggtattggctgtgggtttttcgtagatgcatttatcaggttgggatgtttccttctatttctagtatgttgagtgtttttatcataaacaggtgttagattttgtcagatagttttctgcatctgttgaaatcagcgtgtggttttggccctttattctaatgatttttaattcattttcagatgttaaaccaacttaaaattcctgggataaatctcttttgttcatgtataatcttttttatatatagctatatttgatctgctagtgttttgttgaggactttgcatctatatttataaggcctgtaggtttcttttcttgtgatgtccttttctggctttggtatcagaataatgctggcctcacagaatgagtctggaaatgtttgtttcttccccgtttttggaagagtttgtgaatttttctttaaatgttttgtagaattcatcagtaaagccatctgggcctggacttttttatgggaagttttaaaattattaattcagtctctttgtttgttataagtctattcggattttctatttcttcttgggtcagttgctagaagctgttctttctaggaatttgtctattttatctaagttaccgaatttgttgccatatagttgttcatagtatttgtttatttctctttttatttctgtaaggtcagtagtgatgagtcttttctagttttctttttgtcagtctagttaaagatttgttaattttgttcttttttttttttcaaataaccaacttttggtttctttaattttctctacttttctaatatttatttcatttatttcctcttttattatttccttccttcttcttgctttgaatttagtttgcttttctttcactcgttccttaagccatttttgctttttgaattttctcttgtaaagagtatcactctgtcacccaggctggagtgcagtggtgcagtcattgctaactgcagcctccaactcctgggctcaagcaatcctcctgcctcagcctccctagtagttaggactacaggtgtgcgccaccatgctgggttaattttttaattttttgtagagccacggtcttgctatattgcccagcctagtctcaaactcctggcctgaagtgatcttcctgcttcagcctcagttttgctttttgttttctatatgtttcacatcttttttttttaacctctgttcctcttttactgccttgttttgcattaagtattttctagtgtagcattttaattcatttaattattttttaactttttaaaaaagtttttttcttaattgttatcctaaggtttatgatatacaccttaacttgtcagaatctacttcagatttgtagtaagttaattccagtgagacacagaaactttatttttatatagctcccttccccatttttgtgctattgttattatatgtattatgtccatgtgtgttacaaatctaacaacacttggttacagttattactttatgtaatcttatgtcttttaaagaagctaatagaagaaaagagagcatggatatatttatagagtttaaaaaatactaaccttcttaattaccattgctggttctcttcatttgttcctgtggatttgagttaccatctagtgtcatttccttattccagtgcagctctgttcccaacaacctcctttaccctattgttgtcaaatatattatatttttatatattttatggaaaacaatgcaattttatagatattgtttatgaaattgctttctaaattatttaagaaaataggaaaaatatgtaattattcttatatcattacctacataactacctttactggagctctttggttatttgtgcgaatttaaattgctgtctcagccaggtgtagtggcatgcacctgtagtcccagctgctttggatactgaggcaggaggatggttttagcccaggagtttgaggctgcattgagctatgattatcccactgcattccatcctgggcaacagagcgagcccccatctcttaaaaaaattgctatctaatgtcactcccttttagcctgagaaacttcctttagtgttttctgtaagtgacaatggattcacttagtatttgtttctatgggaatgtctttattttacttttttttttttctgagatggagtttcactcttgtttccaggctggagtgcaatggtatgatctcggcttactgcaacctccacctcccaggttcaagcgattttcttgcctcagcctcccaagtagctgggattacaggtgcgtgccaccatgcctggctaatttttgtatttttagtagagacggggtttcaccatgttggccaggctggtctcaaactcctgacctcaggtgatctgccctccttggcctcccaaagtgctgggattaaaggcatgagccaccgcgcccggcctattttgctttcatttttaaatgatagttatgctgggcttaagggttgacagtttgtctgtttgtttgtttactttctgcattttgaatatgtcatctcaataccttctgctctccgctgtttctgttgagaagttagctgttaatcttattgaggtttccttgtacatgatggataagttaagtgtttcctcctgctttcaaaattttctctttgtctttcaatacttcattatttcagcaactgtgatacatctgggcgtggatctctttgtctttatcctgctagaagttcattgagcttattagatgtgcatattaatgtttttaatcaaatttgagttgtttgaagccagtatttcattaaatattttgtctgtccctatctctgtcatctctccttctggtactaccactatgtatgtaatatgttggtgcacttaatgctgtcttacacttctctgaggctctgttcattttgttgttgttgttgttcttcagactgaaaaatctctattgcctatctttattgttgtgtgtgtgtgtgtgtgtgtgtgtgtgtgtgtgtttggcttggagactgctttcacaggtcaagaagtttacaattttgctccatgttcaacaagaactattactttagttttctctccagtcattcctgagagggcctagtcttaggcatatgtacagtctttcagacctccaaggatgagtgtgatttaattttaagcctggctgcctaggagtgggccctggtttagggtagcttattgttcagtcagtgatttgtcacaggttgtgagccagtaaggctgtcctttgttgcttgaattgtgtgtggcttgaggaatgttttgcagtctgtcccacgtcctgccttgattgctcctgaagtaggtgcagcctagtgcatgtgcacagccttccaagtccatagggatgagtatgatcccatgaggtgtcttcttagctgtttctttccatggttttctctggcaaccttctggctggtctgccatttttcttgttgctactagtttcatgaagctaccagccgtcttaactgcttgccgtgaagatctccattgttttcgacagtgccctcaggcatgaacttctccatgctctgttctaaataacgagcccccttaggacagaactgtggagctctccatccttaaggcttgccttcagggtctgcctctaagccactgccctggagctgggggtggggagagttcctggttctcctggagtgacaccccttactctaagagtgggtactggggaggtggggaggggataggagtccctgatcttctcagcttgcctctcccagtatggagcttgcatcctattagccagctgtggtaggatgattgaggcctagcattcttggcccgttgtgcctggggtaaagattctgccctacaagctgggactgggtgggagaaggaagcccagtcctcttggccactttcacccagaatagaacttctgcaatactgagctgggagagatgagacatgctcctggagtgaagctgaaacccgtagacttggagctggggaaatagagaaccttgctttcttggccacacccatccagaacagcgcttctgtaacatggagctggtgaggggcagaactggagcaggtcatggctcagatgtcacagactgtatctgttcttaccaatatttagtagattttcttgaataaatgtttctccacttactgtgtgctctgaggaaaatttccagagactttaaatggttatttaaaaaactttcaccagcgaaatgattgtttcactgaggaaaagcatctacttccaacacagccattctgtaagtcctgtccccttactgaaaattgtgacagtggaaaaaaattttttggtgtgggcttctctgtatatcatctctactagaactcaattaagcccaaactcaagattttattcaggaggaaagaaagcatatagaacagtgaaatggtgttacaatgtgaggcttactttaaaaaaaataaagagtttcagacttatcacataaatgttgacgttttgcaaagtagctattctccagaataaggcattaatcagaaggggaaacagtagtaattatgtgtaaaacattctgatccctggagcagcagaaataatctcatccctgggaacccttgtgggttaagtagggccttctctgctgttgctccagctatggttttgatatttctttctaattttttatagagaaaaactatcatcagtaaatattggcaagagcacgcaaaatagcccctcatctggtctctagaaacatacaggctgggtccacaaatgcagaaaagcagattgtgacattgctgtgactttgaactgctttagtgatcccttccatgctgactgttggcaaaagctcgttttccttctctctgccttgctttctccctccctgaacaatagcaaggctgtggaactcctaccttaatggaaagtgtgatagcgctgtgccactgggacagatacctcctttggatttgataccctctcctcaattgtatctcttcttagcctgctcatccccaccattttatcaatggaatagtcaattttaaagaagtatgggactccaaagagaagattcagccatggcagctgtcacttctcttcccccttgttcagcctgtttgtgtcttgtttgtggacatccactgctccttagtgcctaaagctggcaacctcatatgctggccgcaggactactgggctggagaggcagataccaacccatctgtgccctggcgacactccgctatttgcctttgcaagagaagttcacaccgaggagtgactgctggagacaattaccaccacagtggtgacctggcctttcagtttcttaccctgaactcctctgatttactctctccatcattcatacacccatttttatcaagatatcactctttaaatctctgttgggagcacaacctctctcctcccacagcttcccagcacacctgcagtatggtctcttggcttttgcccaaacatttgtattttagacactgcttctccacaccccacacttgtctctccgtctctctcttcctttcccctctctccccatcagtaaatgctttcaattgcttctctaaagagcctataccccgtgataccctcctttccttgaccttagacccttcttattatgacaattattatctccaggcccattccctgccccttcccctggctgttttctctcctcctcctgttggctctgagcttgctttctttatagtgatggtactttttttctctcccaaactagctccttcctcatcaccattcctcccagcatcctggtttgcagcagtcaggtgaaagagagaagcaggtcccggagggtcttggggcatgtccctctctgtctcagggagaaagctgctgctggccctaccactagtatcctgtgagaataacagcccagtgctgccagaacctataggtcttcaagagaagatagaaactccagattttaatgtaaactgtctcacttttaaatgttgaaaactattctttttttccccaagaacctggggaaagtagcaaaaccccccacatctctgggctagatttaactcccctatctcccacattaactcagttgcccagttctggaaagctgcctgctaaggacatatcctccatttcactggcccactgtggtccctgcctttaagccttgtcacctggatgactataatggccacctaactggtctctctgcttcatgcccctccccgcccagtctactgtatacaacataattgcctcaaaataacagagtcttgtggtgaagggcttgtactctgggatctggctgtgtagatttagtcccagctgccatttataagctaggtaatcttgggcaagttagttcacctttctgaatctctgtttccttacctgcaaaataggaaaaatagttatacctcctcataggcctgttgtgaggacttagtaagcctgttgtgaggacttagtaaagaaccatgcctaagctggaataagtactcaataaatgttaaacaaaattgtgtcatcccctgttgcaaagacctccaaaggctccaatgcctcttaaatacagtttagcccctttgtctagacattcaagaccctcttgatctggcttcagccacactaggctcctgtcttattaatttttttctcccctgcagtgctatatgttctcactacctctacactttcatcccccgcagtaacctgtgaggcagctgctatgattatcctcatttcacagatgagcaaactgaggctaagtgtcctgcccaaggcctcccgacctggaagtggaggaagcaggatttgactccagatctgtctgactaaagcctgttgtctttccactagaccgtagagagggaaaaacacacagtgacaggaagacatgagagagacttgcgattcacttctccctagggaaaaccacagagcattgttttttctccatgagaaaccaatctgaaagagtggtgtaaccatgtgagaatgatacggggtgggttggggccaggatatgctgatgcttgtgaaaactgctgaagtcagcacaagggacttttaaaactagatttagaacaagttgcaaagcaagaaaggattggccagctgctttggggccaacagggtaatattactttttggctccttttgtaacaggtgtggttaagctctcccttaaaggctttggcaagatgaggttagcatagcagttaggtgccccagatggagaaacagaattctcaggttcaaatctccattttgccacttaaatctgtgtaaccttggaaatgttatgtctcgttttctcatctgtaaagtggcagataataataacacctacctcacagggttgttgtgatgattaaataaaatagtacatgaaagctctcagaacattgcctcacacacagtaagttattttataaacagtagctagtatttgtccttcatgaatatatgtgctcaaacttggtggcagtctctctctctcttttttttttttttttgacagcgcctcactttgtcattcaggctggagtgcagtggcacaatcttgacttactgcagtctcaacctcctgggctcaagtgatcctcccacctcagccccccagtagctgggactacaggtgtgtgccaccatgcccagctaattttttgtagagacaggctttcgtcatgttgcttagcctggtctcaaattcccgagctcaagcgatccaccctcctcggcctcccagagtgcgaggattacaggcatgagccaccgcgcctgtctggtctctcttctttcttgacctattccaaaaaccaagaccatggccgcaccttctatttgtagacatttagaaactttccaaagtgctccagacacctcattaggaggatggtggaaagtttctgaaatcttaaacaactttctagaaggaggtgaccatactcttttatcccacctcccttattacatactgcttgcatttgtacagcccactagtataagtgcacagactctggagaggggtggcctgggttcagattccatccttgctacttactctctgtgtggccatgggaagttacctaacctcccttgacctcaattgtctcatgtgtaaaaaaaagagataagaataacaactctatcatggggttgttatgaggattaaacaaattaattcatctaaagtgcttagcgcagtacctaccacataagaagccttaatcaaagtagctgttctcattactattagaaaataaactaagaaatcattaggcatcccttaaacttctcttttaggttttcctttactagctagttctcacatcaccttacattctcagcccctgattagagcactcgcctttataagggaatcttggactgccgtcatatccctcccttggacctgccaacccctgcccttgggtggtgctttatacccaactgcagccataaggctctcatttggtgccaggactctgcacagaacagcttctgaggtaatcctccatagactgtcaagcccaaaaagccactcgctataggtccttaacctcattctgcataggactagaagaaagatgtttcccagccagacacactttattcagtcatggaggagttgaatggcacccctgcatcagatcagaagctgctggcacattcagtactgctattcaggctactgcttatatttctgttaggctggccctggccctggcatcatttagcctatcttgggctcacatcttttttttttttttttgagatgaaatctcctatatctgttgcctctcattttactacagaaacttgtcaaggtttttttttttttttttaattatactgtaagttttagggtacatgtgcacaacgtgcaggtttgttacacatgtatacatgtgccatgttggtgtgctgcacccattagctcgtcacttacattaggtatatctcctaatgctatccctccaccctccccccaccccacaacagtccccagtgtgtgatgtttcccttcctgtgtccaagtgttctcattgttcagttcccacctatgagtgagaacatgcggtgtttggttttttgtccttgcgatagtttgctgagaatgatggtttccagcttcatccatgtccctacaaaggacatcaactcgtcctttttatggctgcatagtattccatggtgtatatgtgccacattttcttaatccagtcgatcattgatggacatttgagttggttccaagtctttgctattgtgaatagtgccacagtaaacatacgtgtgcatgtgtgtttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacgtcctctccagcacctgttgtctcctgactttttaatgatcgccattctaactggtgtgagatggtatctcattgtggttttgatttgcatttctctgatggccagtgatgatgagcattttttcacatgtctgttggctgcataaatgtcttcttttgagaagtgtctgttcatatccttcacccactttttgatggggttgtttgtttttttcttgtaaatttgtttaagttctttgtagattctggatattagccctttgtcagataagtagattgcaaaaattttttcccattctgtaggttgcctgttcactctgatggtattttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaaaggatccagtttcagctttctacatatggctatccagttttcccagcaccatttattaaatagggaatcctttccccatttcttgtatttgtcaggtttgtcaaagatcagatggttgtagatgtgtggaattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgagctctaaagtagttttttccaattctgtgaagaaagtcattggtagcttgatggggatggcattgaatctgtaaattaccttgggcagtatggccattttcacgatattgattcttcctaaccatgaacatggaatgttcttccatttgtttgtgtcctcttttattttgttgttgggctcacatcttgcccaacatcagctgttgtcaacaacacctgtgctcatctaatcatttagctcaggtgtctcaagcactttttacatgccaaacagtgtgtgtgtgtgtgtgtggggtgtgtggggtgtgtgtgtgtgtgtgtgtgtgtgtgtgtgtgtgtgtagtgtgtgtacatatgtgcataaggataagttgaaagagtcaatgaacagaatgaagcctacttgcaatccagtgcagcactgtgagtctgggctttggagacagatgggcctgatgcaaatcctagctctgcttcttgtcagttgggcaatgtgggacaagttaatctgtcttactttgatcagctataaaaggaggatagtagaaagatataccgtgaagagttactgcaaaaataagaggtagcatatgtgagtgcctgatagagacctaatcaatgatttttgtaattattattttccctagacccaattctcaactagggtgttgccccttgaaattaaaaaggagaatctacatgcaaaaatgaataatttggactcctaaccttatatcatgtacaaaagttagctcaaagtggatcaacgacataactgtaagagctcaagctgtaaaaccgttagaagacagtgtagttgtatatctttgtaaccttgaatcaggcaatggtttcttagatataacaccaaaggcacaaaagacaaaagaaaaactaggtaaattgaactttatgaaaagtaaaaaactttgtgcttcagaggttaccaagaaagggaaaagacagcccaaagaatggacaaaagttttgtaaatcttatggccaggtacagtggctcacgccagtaatcccagcactttgggccaaggcgggtggatcacttgaggtcaggagttcaagaccaacatggcaaacatggcgaaaccccatctctttttaaaatacgaaaattagctgagtgtgttggcacacacctgtagtcccagctactcaggaggctgaggcacaagaattgtttgaacccaggttgcagtgagcagagatcgtgccactgcactccaacctgggcaacagagcaagactctgtctcaaaaaaaaaaaaaaaaaagaaggtttgcaaatcatatatctagtaaagaacttgtatccagaatatataaagaactcttaaaactcaacaataaaaagacaaacaactcaatttaaaaatgaacaaagatctgaatagacagttctccaaagaagatatacaaatggccaacaagtacatgaaaagatgttcaacatcattatccatgagggaaatttaaatcaaaccacatgagatcccacttcccacccaatagatttgttgtaatcaaacatacaaataataagtgttgacaaggatgtggagtgactggaaatctcaaataccactggtaggaacataaaatggtgcagcctctatggaaaacagtacagcagttacacaaaaggttaaacatatgacccaggttaccgtatgacccagtaattccactcttaggtacatactcaagagaaataaaagcatatgtccccataaaaaaaagcttgtacataaatgttcataggagcattatttgtaatagccaaaagatggaaacaacccaaatgtccttcaatgtgtgagtggataaacagttgtggtatattcatatgatggaaccagtcataaaaatgaatgaagtactgatatatgctacaacatggatgaaccttgaaaacactaggctaagcaaaagaagccagacacaaagcccatatactgtatgattccatttctataaaatgcccagattaggcaaatccataaagacagaaaatagactagttgttgccaggggctggagtggggaggataatagagagctaataagttagggtttcttttggggggtgtgatgttatgaaatatatatttggtctttgtctccatttcctggcatacaactccgaaaatccttggagtctccaaagtgatgtctttttgtatgcctatgagttgactgatggttgggtagcccaagaatagggactggtcactggaaagaccaaggcatgaatagagggttgggactttcagcccaacctccagggacgggagaggggctgaaggtgaagttgatcaccaatggccaatcatttaaacaatcatgcttacataatgaagcctccacaaaaactcaaaagaacagggtccagtgagcttctggatagctgaacacgtgaagattcatggagggtggcctacccaagtagaacatggaagttctgtgccccttcccacataccttccttgcttgatgcatctcttcatctgtatcattttttatgtcctttattatagaccagtaaatgtcagtaagtgcttccctgagttctgtgagctgctttagcaaattaatagaagaaaagagggggtaatgggaactccaatttgaagctggttgtccagaagttccagaggctagaacttgcaactggtgtgtgaagaaggggggacgcagtcttggggactgagccttcaacctgtgggatatgatgctatcttcaggtagatagtatcagaattgaactggaagacatctgtgtctactgtagaattgattgcttatttggcgaatggggagagaaaatcccacacatttggttacagaattttctgtgttgattgttgttgtggtgtgagaacagaggaaaaacagtttgtttttccactatcaccgggaaatgatctaaaattcactatgatgatgggtatacaactctgtgaatatactaaaaagccattgaattgtctgctttaattgattgaattatatgctacgcgaattatatctcagtataaattttgcttggtgctatgtctcacgctggtaatcccagcactttgggaggccgaagtgggaggattgcttgagcccaggacttcaagaccagcctgggcaacatagtgagaccccacctctacaaaaaaaaaaaaaattaaaattagccaagcctggtggcacacacctgaagttccagctactctggaggctgaggtgtggagattactctagcccaggagcttgagggtgcagtgagccatgatcacgccactgttctgtagcctaggcaacagagtgagaccctgtctctaaaaaaaaaataaaactgttaaaggaaaaaaaaggaatgagaaaggaactacccagagccaccacagtggacttgaaaaagttatggttatttcttgatgataagcttaacaaggggtggattattcatgcctcccctttttagaccttatagggtaacttcctgatgttgccatggcatttgtaaactgtcatggtgctggtgggaatgtagcagtgaggatgaccggaggtcactctcatcgccatcttggttttggtgggttttagccagcttctttactacagcctgttttatcagcaagggctttatgacctgtatcttgtgccgaccccctatctcatgctgtgactaagaaggcctaacttactgggaccgcagcccagcaggtctcatccttattttacccagcccctattcaagatggagttgctgtggttcaaacacctctgacatttcccccctcacttttataagagaacccttaatcctaagggttgcagagggacaaagatccatcttctaatgaatagcggtgatgatattcctgtctaactattagatctcttgcaatcagggtagagaggagctcagtcagaaagcattggtatgtcatgggccattcacaattctgagttctgacaaaaggtgatatcttgaagattaataagtattcaatgtaagaaaacattcggtaagcttatcctgcattcctacacaaagagtacaacagcaatatattccacaatagtaaagcaaaataagtaaaattgtccctagtaaactaaattagaaagctttccatgaactaggcatttgttggaaccaagctaatatggggttgctagccaatttcaatatgtgcccagaattggaatactgatccagatttttacattacccatccctcttgtttcttctgagaagcagtcagagatcactggatgattcacaggaataagcagagtcagtataaattgcagaaaaatacttaaaaacaactaatgagactaaaagctaataacaggtataccacaattcttgaaacataattttttctctctccagtctcccatttttactaaaggtaaatcatggtaagactgatttgctttattatacctggttggactgtttgtataaagtgcagcaagaataattatttttcacataagccctttttaaattggctttaatggagctctatttctttcctttttttttttttttgagatggagtcttgctctgtcgcccaggctggagtgcagtggcacgatctcggctcactgcaagctctgcctcccgggttcatgccatcctcctgcctcagcctcctgagtagctgggactacaggcacctgccaccatgcccggctaagtttttgtatttttagtagagatggggtttcactgtgttagccaggatggtgtcgatctcctgacctcgtggtccgcccaccttggcctcccaaagtgctgggattacaggcatgagccaccgtgcccggctgatggagctctgtttcatagatggaatctcagatctttttaaagccgagcccagccatggatttgtgccctcaaatacccataagttgagtaaatccctctccccttgaggtcccaagataacttggggctcctgggcctgtcagaaggtgacattctttaaacttaccacaggtcaggaaccttgtacaggaactgtgtagacaaggtatgaggccagtttcccaaggggcttttattggctctataagtcaagtttgattccttaaaggaaagcacaccattccattcaaagccttggtaaaataaccagtttctcaaattgtgtcctgttgcaaaagaaaacagattcttattgcacttatgcaaataactattgctataagttaagaacactcacaactagtttccaaattctggagaaatcaggtagagagaaacaaatatgctccaagttttattcccaggaatatactttactcaattgttaaaagctgtaaatagcttaaaagaaaagtttctttgactctgaaaaacaaaacaaaaggatccgcaatgctttaagctaagttaaaaaagattgcttcagtcttctattaggtcagtccattcagtcaactcctgttctgctttatattcatgaacatttcagctttccatgagtcttgaaagtttttcctctattctaatgtcataatctccaaagttattagaaacctgcattcaagaacacctgttagagtcctgtagctgattataaaccaccttttaaagaggatcaaaacaagacaacaattgcctgtggatgacaaaatgtcttagggcagccacagccaaaaacatgattgacaaagaaatttggttacctctacggcacacaatgattttatgtaataattataattattactgataatatatgctaagttatattaggattataagagtttcccataattttgaacacataccaataacatatttctagaaatacagcccaaaaaagccaaacaccatcttatatttgagaatgtttcctgtatgacttttataccaaataagccaaatgtcacttttggactttaggcaacctaatatctaaaagattaattaggtcagaaaaagtcatagtttataatttcactttggaaagcttatcaaatattaaaggcttaagtcacttgatattataaaaagaatcccaggtcaccgtaagtcactcatttaaccaaaatgataaatattttaaaaaggcaaaaccccatactcactaagagaggagagaatcagctttctaaacaagacccaataaagacagcatgaggccaattgaatcttgaatctgtcttttctttttcccctccctttttccctgccatttatccaaagtcatagacaaaaacctttcattatcttttcatattatgtaaaaatcttttttgaaacagaaaaccaaatttcatatttgcattagtgcatttttcatgccaaagctagttttaaataacattttataagtttatccagttttaattagtttgaccataaggtatgattttcataaacctcttataactctttataatttttgttaaacagatcaatcttctaagaaaaccctgttatttggacacgtgggcccaaattctggcaccaaatcagtatgcttttagtccaatgttcagtttatggaaaaactgaatacccctttaatttgagcgaatatgttcacacacagaatttcttttacaagattaatttttcacaaaccttccataacttgctcaaaccttcagctttatcttatctaacttaaaacaatccgttaaccctttaatctaggcaagaaaaaaaaatccacattcccatgcctttttataatcttttaccaaaaacacatttcactttctttacacactttgcatgtaaaactgtttctttaagctgggcgcggtgactcacgcctgtaatcccagctactcgggaggctgaggcatgagaatggtgtgaacccaagaggtggagcttgcagtgagctgagatcgcaccactgcactccagcctgggcgacagagcgagactccgtatcaaaaaaaaaagaaaaagaaaaactgtttctttagtagtctcaaatacgtgttacacggttaattcttagcaacttttacttttggtgaaaagcttggctagtaagccattgtagttaggtaccaggtctggagtctagaacatcagacagaagtacagataaaggctgactctttccagcatacgtagggggcatggctgtccatatgtccccaggccttatctagaatctaatgctccaaggtagtaggtaaattgaacaattttcaaaagtcaaagaagcagtttatgaccttaaagcatttagcaaagctagtatgtgaccgaatttagaccaaatgtctaaattttgaagacatttttattttaccagtaacctttaaaactgtttttatttcccaaagattactaaagtcacatgaaccaaaaggctttgtacttttacttttctgataaaatatttgatttaagctcttatttttaaaccaattaatcaaaacccttttatactacacacacaacacatatacatacacagacagacagaagataaaagagtcattccctaagccaggaattgaaccctgaagccaggccaccacggtgaagacacaaagccttagctactgagctacagcactgggaagtttccatttctcttcctagaaggagcctagaacagccaattttgaacttgcaaaagcttttaactgcttgagataattttaagggctaactataacatgaaaccccaaattcctgtccactggatgatggcaaccaagagaaagtactgccacgtggttacaaggttaagctcccaaggacatttttcaacatgtagtctctggcgagacagtcgccctgagtaacagacaagataagaaatggaaaagagagaaagaaagagagaaaaacattgctgcggcaggatggggaaggcgagttgctcacggaggccagagaaagatccacccattgcaatgccactgaaaagttcaggttttgttgaagggatcttttttgaaggttttgtttgtcaaagggatcttttccagcattcccatcagctctcaagtttccccctttagggaggaaaaagctccccatgtccaatgatcctgtatatacctaatcttgtcacctacagccatcagcaaaggcagattaattcaaagagaatagcagttaatagtagtgccaaactcgttcttagtcgagagggactttactgagagggatctccaaccccctaaatcttagaagggactctaacgctcctaagttgggcttctaacccaaggtcagtcaagcgtccttgacttttattaagaggggtctttaaccttctctgtcttaggagagacactaactcccctaaattgggcctctaactcaatcccatcttttacactggtaaatgcaccccacttacccaaagtcggccaactggtgctgcagactatttcctttgggttgggggtctcctcagtatcgttccttcagggtttgccagaaagatgttaccagaaaagggtccagatccagaccccaagagagagttcttggatctcgcgcaagaaagaatttggggtgagtccatagagtaaagtgaaagcaagtttattaagaaattgaaggaataggagaatggctactccataggcagagcagtctgtttaccaatttctggttatctgttgacttcctgccaagctagttaaagatttagcaccattgtctaactcatcactattttgtattcttttttggttaccccagtaagctatgcaatatactaacactttctatgtttttgttccatcaagtatgagctgcatcttttgagtccccacttggtaggctaaggtagtggcacccttcttcttcccctcagctctgtaccccacccacccttctcaccaggtggtgctttggcaaaacacttggtccttattttgaaagaccttgtctttaaaaatacaaaaaattagccgggcgtggtggcacgcgcctatagtgccagctactcgggaggctgaggcaggagaatggcgtgaacccgggaggcggaacttgcagtaagtcgagatcgctccactgcactccagcctgggcgacagagcaagactccgtctcaaaaaaaaaaaaaaaaaaaaggtggaagatgtgaaagataaaactaatttttattaagcatttactatgtgccaggaactatgcatgcatcatcacatttaatccttatcgtagtcctgggagggaaatatcataattgcaattttagaaatgagaaaactgtgaccagaccatgcatctggtagggggtcaagctgagatttgaagcaaagttgaatccaaagcccctactattttttccagagccccaagcatccttcaacttcagtttcatctgcagattttcaagtctcttttctgtagcgaaggcttggactagcagtctttagctatttttagaaccccacagtgattcctgctcattcaccaatgctgcagcctcttcccagagggcaaagaaaagggtgacttgagaggaacctgaaggcaaatgaaccatccctatggggtgtggggagagtagatcatctggatgggtttgctgattcagttgcatgcctggcaggcttctctctacctcgtggctcgggcattgagctttggaagccagtacagaagtcccacgtggtccctgaggtgacatgggaatcattttaccgcatcaccagggctccgcctgccagcatgctgcctttgatttgagaagcaaatacagaattttgaagattgtagctgactcagaccattgttctggcattgcggtcatagacacatgtgggaaattcccaaattgactttcccacagagctgctttggagtgggggacaaaaagagttcgggggcggagaatgtattttagttatttatttgattagtgcttgttaaatctttggactgtttcaactagaggcactgaatgggatttccccaggggtcacttctgggcatctagaagagtcaagaggtcaaaaggcccagactcaattttccatactgaggaaggagaggctaataacataaaacagacagtcccagattctttctattggtctacaggctgctgtcacagaaaaacatttggacgttcccacccacatactttcccccaacccatgtcctctgggttctccctctctgttggcgatccagccatccagcccacctaggagtcatcttcattctaccatctccttgcctcataacaacccttctccttcacccgtgggccaccccttctacacacacacacacccatacccaagaccaccccgctcacactgttgatttgcagggtcttacacattcaccctttctcctttcttgttagtgacctccaacctcatcacctcaggcctactactttctgtgcctccagttacacctcccacaacactggcctggccccaatccatcttgtcaacactgctagatgaatcttcctgcagaacagctttccaaggcctgctcagacttccccaaggcttctctgctgcttccagcataaaatccaaatgcctcagcctggttttcgagaccccattctacctgctctctatttctatttccaagctctgttcttgccacttccctactggactgagaacttcttgaagatgaagaacaagcctggctaactactggggctgtgacaggacaggagagtgtctaggacattgggagtcaggacctgtttgctgagggagtgaaggaatgaaagaatgagcgtggttaagccatcacaagactcattttgccaaatagttgtgcagggtcctctgtcactgaccagttgggtgaccttgaataagtcccttcctctttctgggcttcgtgtcttcaacaggtgtctcaaacttgcagctcttgggcccaaagggcctgcaaacatgttttgttggttggcacattaacgtgattttgaatgcctttctggaaagcgtgtgtgctgtggttccccactcttctcccattttcttacacctccccacctcccttattttcattagctgcttggtgcctaaaggcatttacatttgtgactcttggattaggtggtgtttactcacctttcaactctggcgtggctggaattctctgtttgacctgctttgaaatgaaaattgcaagtgctttgcttaagtgattcccagtgtcatctaatatacagcagtcaggccagactaactttgccttcccaaaacaggccaccaaagaacagtggaatatgccgttagtatttctgactttggcagtcagctgcagagggagattttattccattgaaaataattgtctttacatagcccagcacaagtggtgcccatttatagactagaaaggaccaagcacagcgtgcctattggcagccagctgggcctatacagagggcactggttgcaggcacaaagtgtgaatttagcccaagttgcctagcccagtcctttccagaacaaagtgctgaatgaggggtgtgtgctagaagcatttctctctctctgtctctctatgtctctctgtgtgtctttctctttctctctctctctctctctctctctctctctctgtctttggctgtcagtggcctagtttgcactaagactccatagagatacgcacagagggcagggaagatcaaggaggcattctcatcactgggttcctttgcattagccaggcccaagggccacatgagttgcagatctgcctggccacaggcaggcaaggcacagctcactgggagatgctagacaaacacagcagctgctggaaggcacttgcgtagtctggacagcaactgagtcccacacatttgggcagcatctgggtgaaaggtactgggaggtgggcagagagggctggtgtgggtgtatgtgcccatcactgggcatagtcaggcactgggtcaaagtggaagcactgatgacctgtggagccaaatggctgcagtcactgggtgtatgtagagcctgggtgtccccaaaatcagtgtggagggcgtagaggggctattcagttagggacacataataacatatccacctgtatgtagcagttgtaggcatctgagatagtgggtggggtggggaggtgaggaaggaaaaggggagaagaaagactgtttctgactaagctgtttcatgtgtccagaacaactgcagggagcttcctgggggaaaaagattgactatgtatctttgtctccctgtttctgccctttcctgctctgctgcttaggaactcagggagacaaagccctagtactgtttgtcaaagtcaaatagaatggataaagcaaactttccaaagaaactttatggaacacatttcaaagccctggagaagcaattttagggttttttgttttgtttctttctgtttttggttttctttgcatgactgccactaacttatgtcagcaaggcgttaagtgagacacttaagatcattgcggctgccaggggaagtgggtacacccgcttgtggggctgtaagacagcacagtcgctgaagggcattagagctgggctgggttgggctaggctgtggctgggactgaagaccgtgaacacagcgggacatgatgtggtgttggtatgactgtgggtgtgctgtgtgttatgtacatgtttgtgacagcactgagggacctggctgtagctgtagtgtgtggatttgttccgtgtagcttgaaaccagggtgctctggcagcgacaggaacaagtatgggccacaaagccagagagccccagtgtcagctagatgggaggggcgggaacttttctcaccttcatttccacatagccagctgggcctgtgtctctggcagtagttgctggtgtctgaaggcttttattccacctctaactggcctgcagtattccagctggaagccgtggaagcccacacattgacttgtgccgtttctggcacactcagctacccccagtggcctggaagcccagcttttcctgcatagcccttggttgaagacccatacctgagccttatgttcagcgaaaggccttatcatcacacagtgaggcttcctgctaaaatgcaatcgcctactgagatgggagccatggaggggattctggggttgctgttctctatcttttgagtaactgggggtcaaggtaagccaagccctggcctggtctgcagctgctgtctgcacactgcccagcctctccacccacttccaccatcacaaggagagctcttgagtaccctggagggtctgaggtagacatgatggtcctgtaggtggtgggcatttgggttgtcatccccatagctactaaccagctggccaggcctggcatggtatggaggctctgtctgaatgagccaaggatgctccgtctttagcagcaggacttttgagcagtgagaaggcactggggttccctggccagaggaggcaaatcaaatgcacgcagggctacactccccacctgcctcccagcaggtaccataagggtgagagtcggccaagtgtaagacaagtcacggtgtgaccaaccataatgcctgtctttttacattacttttgaaaacactatgcaggccaaaaccaaaaaaaaaaaaaatatatggccaaaccaaaagcatctgcaagccacattcagccttctggctgccagtttgtatcaaatgtgaaaagcaaaatttagttgtacatcactgagaattcttttggcctggtgaactctttcttggtcttccacatctagctccaatggcatctctgagccactttctctgaccctctccttaggccaaacaaatgcttctcctctctctgatcccttagtatctattgtaacatattagtatattcattcattcattcaataaacctctattgactactctggcaaaggtagtgctggggttacagagatgaacaaataagaaataacccctgccctcgagaagcaaccagcctgattggaggaaagatgggagggcagacagactgagagatccctgagggaggctccctctgtgtgtgtgtgtgtgtgtgtgtgtgtgtgtaaaagttgaggaaggtaggcttcgggtgaaaaggagatggctcagccaggtgctggaggaacaaaatgagtaaatcaagctgaagaggaggcagggccttactggcgcagggagcccctgagcagacccctggagttatggataccaatggcatgttcacgccccagtgtgttgccctatgtgactagtgtttaaggaatgaggacaaaataatctatacctcaaacccctgaggcatgcagtttacctgcatacctgcacatgtacccctgaacctaaaatcaaagtttaaaaaaaggaatgagatgctgtaagtggctgtggatcttggctttttgtcctctgaaggcaatggggagccacctgtgggtttggagctggggagtgatgagtctgatctcagctttgcaaggcccacactagagcctccacgtgttagacagtcaggaagtggggcgagactggtgatggggggccagccagggagctgtgtccccagtgcctggacctgcccactgcatacttgctgagtgagtgagtagatgaatgaggtaggaagggatgtggagagtggctgctgcccccacccctgtttggcaggggtggctttcataggcatccacttgggcatctcataggcatctcagacttgacctattcaaaccagacccctggccttgccccccaaacctgctgctcctgcagttttcaccatctcagttaatggcagtctcaactttccaattgctcaagacccaaacctcaaggtcatttttgactctcatactccacatccactccattagtagtttatgttgtttctacattccaaatatatccagaatcaaaccacttgttaccaccttcaagatctgttctcctgtcatctctcacctgggtaattatttgcagcagcctcctgacaggtctccctgcctattccagcttggatcctctatgctctactctcagcacaacagccggtgtgattcagcaaaaacataagtcaggtcatgtcctttctctgctcaaaaccctctactggatctctatttcagatgaaaagccaacgtccttacaatggcccacaggccctgcatactctatctgaccccctgacctgtaggacctcacctcctgctctcctgctactccttctgcactctgcaccagccacactggcctcctcactgatccccaaacagcctccaggggctttgcatttgctgttccctctgcctagaaatcttttcctctaggtacctgcgtggttcacttcctcacttcaggtctctctacaaatgtcaccttctcaatgaagctttcattgaccatcttattatagaataacacccccagccctgctggtcccctgagcccctccgttgtttcatttttctccaagccagttattgcattctaacttactacatattttactcatttgttttattcattgtctatctctccccacagaatgtaagcttaatgagaacagaaacttttgtctgttttcccctgtggtattcctagtgcctggaccagtgcctggcgcatgggagacactcagtaaggacttatgggatcaatgaataggtggactgtggggatcggtgaggttgtcctgggctatctcagggccatgtgatctgggattctcaggaacagatcacgtaggggaaggagagagccactggactgtaggagttagcaggtctagccagggtgaccttgggcaagtcccttcccctcactgtcctcaatttgtccatttataaagcaatttataatttgatgtgattgtctctaaggacaagcattatgagcctctgggggcaaggtgggggcctggccaactgggctgccattcatgccccctgggcatgagggcagagatcctcactcctgcagttccccatttcttttttgacttctttcaaagcgccatcttatcttcaccccacatctataaacataccatgtcacagctgttcaaatagtgatggggcggtggctgccagtcagcttcattcagccaggccagctgtgctccctgcagtatgcctcactctggcttgaaggcctgggcaaatccagcagtgggatagcatccaccccatttttcagagcaaacaattctatcacacctgccacacaggtaggcccatcgctggagcaacctcacctcctctcctagaccaaactctgtagaagagtctggtctggtttgggccaagtgtttatcaagcatttgttacattaaattttaatccttatgctaaccatgtgaagtaggcattattagactcattttcagaggagaacattgagtctcagaggggttaagagtgctgcccaaggtcccatgcaggacctcttcccccatgcaggagtctcttggaaatctgctgaccaaggtctaggaggctcacccatggttggagcaatgagacaggcagaaaggatgcttcgttcttccttcagctccatccaggccacaggtggagcctaagtggtggaaaacaggccagcccagatggaagtcatcactatcccactggttccctgagggctgagcaggagggaggcgccttcccgtcttgccctgccaggaatgtggggcgtcctgagaggctgggaccagtgagcaatgggggcggtgtgcgagttactccatgtgataaactattttcctttctcattccaaggatcagagagcacttggtgagctgttctttgttccaatggaaacagaatatcagaaaagcccagtgggggacagtcaaagtttcctttgtcttcttgggctaggaggctgaatgggaggactgtggcaaggtgggtggggcagggccactacaagggcaacaaatcggtagaagggggatcaggacaggactctacgacaacaatgggggaagaaaaacccacaaagagctaagaacgtgccagtggggaggccttacagcctccctcgtgcagccttactctatgtggatctgctaagtctgacagtctccagcaaggggctggggagtcacagcacagctagtgctctcctggcccaagatgtgccaaaggccacctccaggaccactgccctccacacgtcctctgaactccctggcccagtctctttactgcccccataacacaatgtgcttctaccaagaatgataggaattcaaatttatcgaagtctttgaaagtttgccaagcactttcccatagctctccaggaggcagaatagcctactggttaggaacacaggctcagggcccatactgcctggctctgccattccactgctgtgcgatcttgggtaagttacttagcctctgtgcctcaggttcctcatctttaaaatgggaataatcacaggatctacatcttaaggctgttttcagattaagttggctaatgtttaggctccctaaaagcagagatttttgtcttttattcattgccatgtccctagggcctaaacaatccctggcacctggcaggtactcaacagatatttattaaatatatataaagggcttaggatgggagctggcacttagcacaacaagtgttagtttttgttgttatcttttgcattctcacaatagttccaacaggagcattctgaatttcatgcatgttagtgttgctcctccttgtaaggttcaagttctaagtcaaggtactgaaggaatatgcaacagacttaaaatggagggcaaaagtttgggccacagaggattaggagtacagctgtcaaatattagtaaaagcattcgttcatccattcattcagtcatctattctacaaatatttcacaaatactcctaagggccaggccctgagctgagagctggggatgtattgaagacaagatagacaagggtttctacatttgaggagcttaacttgtaatggaaggagactagcaaaaacaagtaaagatctaaaaagcacttattagcacttattcagatagcaataagtgttatgaagaaaatcaagtagtataatgggatagagaatggctggggttgtgtatgtgttggggttgctttagtttatggtcagagaaggcatctgaggtaggaacactggcacttttctggggcgtcttggtctcaggtcaaggacctctgttgagagttggcctgtgacaccatatcatcaccacctcatccttctgcctaaggcaggggtaagctgctcagtgtagttctggggatctttacgtggaggtttagtgtgaagggctggagagaagggggctatgaacatgtggcgcctgcataggaaggttctggcattagttgtcctctggcaaaacctattggttgctctaggttaaacgatggtcagtggcctttcagctcccccttcatctttctgcactctcagggaggaggtgtctggccgtggggtcctctccactgctgatctatactcaatgccctcatgccccatgctcattcatgacaccaccttcacacatgcaaacactgcctcatctttcaagatagctcagacaccatcaccagtcacactggagggcccttattcattacctgtttgagcatctccagagcatagtatggaatggatacctaataggtgcttaataaatgaaggaataaatgagtgactgttgttccttctgcttcctcagctgactggctcattcccactcatgcatcaagactcagctcacacatcatcttacatgagaagcctccctcaacctccttgtgtctgacctggggagctcttgttcatccttgatgttccccttgacttcctcagccagaatttggccctcccacctctgaatgctccaccacattctattaccctctatcgtatccatcgctctacaggcactgtctgctactgtcctgtcacctcccctaatctctgattttctcaggcaaggactgtgttttggtcatctctatatccccagcactagcccctagagggcgctcaataaatatttgtgaaattaatggggaaaaaaccgtgaatgaattgtttgtcaattttgcttagagtggtgtgctggggctggcttgtagtggtttgcgagaatcaattgttaaatatttaggaaacgtatgagccagttgttaaatacagccatcattaaaaattaaattatatgagaaaacagaagacaaactgaaattgagagacattctacaaaataaatgaccaactaaatacaatatgggtcctggattggatcctagaatggaagaaagacttcagtagaaaagctggtgaactccaaataagtttgtactttagttaatgttgtactaagtttaatttctcagttttgatcaatgttttataattatgtaagatgtcaacataaggggaagctgggtaaagggtacacagaaactctctgtactgtttttacaactcttctataagtctaaaattatttcaacatttaaaaaaaaattgtcaagttccaatacttcttggttgtttcactttcttcttactcattaacataaatgaaaatatcaaccatcattcatttaggaactgcacttgctcttctgttatggccgaagtttggctattgatatgtgttcagcaaaaatcaatgaaagcattatgggagaatccattggttatatggaatttataataaagagtattatatatttcagtattatctgtaaattgagcacttcacattcttatataagtaaatttataataaacctatgtatgtatgtgtatatttatatatacgtttgtgcattttttttgagagctggttgctgaacacttaccagaacaccaccggtcctacatatgaattatgatctcatcaaacacattgaaggaaagaaaagaacattgcccagcaccttctctgtgcgaggctgtactatccctttgtgttcatcattacaggtgctctttacctcaactctatgaagtgagggtattgtggtctccattttacagataaggatattaaggctaagagaggttaaatgactagactaaggtcaagtattggtatacagtgagccagcattaaactacattcatctgagtccaaagccaattgtattagtatcatattgctgctgtaacacattaccgcaaattcagtggcttaaaacaacacaaatttattatcttacagttctggagggcagacgtctgagattggtctcactggactaaaatcaagatgctagcagggctgcattccttcttaggactctacgggacaatccttttccttgccttttccagcgtgtagtggctgcctgcattccttgacttcaaaaccaaaagtggccattcgagtctttctcacatcccatcaccctgattctgcttctatacatctccttctctgactctgactctccagcctcccgctttcactttataaaaaccctcatgattacattgagcccacccagatgagatgggcagcttctccccatttcagtcaatgtcagctgataagtaactttaactccacctgcaaaccttagttccccttgttatgtaactgaacacattcacaggttccagaggttaggatgtggacatcgttgtgggggctataatcctgtctatcacccttgtgctttttccatgaccttctcctgcctcacctgtcattttagtggtcacaaaatctgatgtggggcctatggaattcttcctgacacctgcattgccacacatctctgtgctctccctttggagtaagatgcccctttcagtcattcacccagccagtcagacagccttgtaggggaatggcttctaaatcctggggcttttaatcgtggacatatattttacctatgttcttactaaagtgttttaaaaaaatactttccaagatttttgtgcattcctggctttttacttcctttccacagtgcttatatggtgccagagccctcctttccaacatggctggtttcgctgtgctacggtttacccattcccaccttctggacctgtttctagtcagcagctaggatcatgcattatttatttgttcttctcatagacttttacattgccttcttctggaaatggccctggacttaactaaaatgtacttttcccacccctgccaatgaggtatatgtctgtctgtgtttactatttctctctgactggcttctcagaaacagactctctaagtaacagtttcccatcttcccttgtttcctccacactgagatccctaattcttgtcacgagaaacctcctccactgagaccaaccgaatggccagaagttgcccctccccccaggaagccttaacagccagacccatctcttcaccgcttgtgagctctgactacaacattcttgtctctaccttcagtcttgtcaacagctctttgctcctcctttctacctgtcagacttacacccatactttggggcccagtctgaatcctaccttaaggtaggctcaccttgaggaaaactttccagatcatcccagcccaagggactcatgtcctctgtatgtgtctaggacttattgtcagcagcacttattttgacaaatttatcatctaccattatggagaggttgcaaactgttggctggtgagccaaataataatgcccacaggtgtattttgtttagtctgcatgtggtttgtttctttttaaactatgtgctaacatgtagcaattagtaatctttccatacaatctggatttctagcttctttgaaaaacagaaaaatctggtaatactggatctgtatgcccccaagacagtagttagctagattggcatggccgggtggcagcttccactttagatggagtatgtgctctccagctagacacagtccccactactccgtattgtctcactccaacctcattcactcatttatagtaccttcctggctcctaaaggcatttgagttatctgacatatttcacacctgcctaagtttccagctatattacagtctcttagaggaaagaaactttattttgaatttattttgcttcttttatgctgctgtggacatagtagatgcttgatcaatattgagagaagaaataattttactctagataattctacagtgtgttagaatttacttttgctgcaagataaagctttataaatgtaacatctattaagagagtaccatgtacccgactcagtgtcagatgcctcggagcaactttgtgattagtgatattgttctcatatcacagataaggaaaccgaggctcagagagcctatccagtaggactggagctgtagatctggtagtctctgtggtaagaaccaaagcctttgttccatgaggaaaccttcctaagtatcaatgctggaagcagagaggagcttcccctgaggctctctggtaaagtttgtttacaaactcacaaactctgagacttaatttggtttggatagagattgagcatttattaaatgcttattgtgtgctgggtatttaccaaataactgcacttatttttggactatcaggaattctgagcatcctaggtagcccactgataagatgagggaaatacacataaatagaccctaattgctgatgggatttggaacccatttggtgagtcacattcaattgacagagtgcccactggttcccttgtccatatgcgcacagagattgtgctattccctcatgctgtcactggtggtactgacgtgtggtgcgggatgggaaaacatggagaaattatgcgtgtttaattgcacagcagcaagcagaaaggaatgtgagtgccaaagactcccactgaagcagaaatctggtgtcgtgtgttgctgaacagctgcaggaaaatttgtctggacctttggaggcagagaggtgggtttgccatactttggttctgagtaactttgagggcaacgaggatttataggcagcagatatgtacatctagaagtttcactctggagctttcacctggtttctttgctaccctatcccttccagccaccaccagttcaagccatggctaggagcagagggagataggaaggcctcagccccagggccactaggttactccaggtttcatgtgtccacagccctgcttagggccaccaaaatgctcaggttcagctgggtgggctaaaccacctagaactgggttcaactctctcctctattcctacaagtatggccttatgcaagtcacttaatctcttcaggcccaagtttacttctatgtgtgaggagtcagaaggtgatgttgcgtggggcctggcccatatcttaagagatggatctatgtccataacaccctgaatgctcccaatctcatcaagagatgggatctgtaagctctataatgattcagttgaacaataaactatcatagtcgttactctgtattgcgggcctgacagaccctatgctaagccattcatcatctctttaatccttaaaggaaagattaaaaaaatcttgagttaggagaggaagagtgactcatggaaggtcacccagctagtaaataacagaaccatcatgagctccaagcagagccactctagagccaacgcttctaaccacaccacctgcctggcattagttccacttcacacatgaggaaactgaggtttaggaggcattattatcaggggcaggacttgggtttgcaacttctgtctcttttgtttaacttgctgtgtcactttggacaagttgctcaacctctctgagctttggtttcctgatttggaaaatgtcagagtccaaagcctctggcagcagtgagaagcagtatcctgtgggagatggtggaggggaggggctaggaatgtcccggagacagagaatgagaagacatgggtgtgactgtggcattatgaagtggaggcagatctggaacggagacttgccagagtgaatgtgcctggctcgcactgcctatttagcagccgtcctgtgagagcccagatgggccaggtgggcaggaatctggccaggctccacaggcacacccacaccgtgagctgctgttgccacctaggggacaggcagtgaccaggggcccaagtttggctgtggctgtggctcagcggctgcacattcccagtctcctgctggtttccggagcggagagggatggccacggcttgctccaggagtggggaggggagtaaggaaaagcagtgaggagtgctgcctctggtttgggagttataaataaatccatctggaagtgtttggggctgtgggagcctgaggtcggccctgcaattcaggccatgtggtgcatatttccattcacaccagaaccacccccgcagccccctaccgccccgccccagtcccaggggactgtctgctaggacctgtccgctccggcccaggagagctgggcgagaacctttcaggccccagttttcagcccccacccccaccttccgctcctggcagcccaacttcagcaagataatgtctgagaaagtgcttcaaaaagttttatgtgctatccaagtgttggttgaatgaatgaatgaattttcaattcagcatttagcttgtaagctccccttgctgggaaggggccccttggtagttatggaaggcgaggcattctggacttttagcctccatctcaggatcacgtttcccacccaccgagctaaggcaggctgagatacaaatgcatattgcccaagttttgttcatctttctatcctcagcaccaagggtagcgctcagtaggcattggttatatgaatgaatgagtatctatattaatttttttaaacaacttttgtagagacagaggtctctctttgttgcccaggctggtcttcaactcctggcctcaaggggtcctcccgccttggtttcccaaagtgcaggcattacaggcatgagccactgcacctagtccaatttgttaatttaagcagcacttattgcacatcctcatgtgcagtgcactctgctgcatgctgagatcacagtggagaacaacatagagtccctgcctcattgagctagtggtcactgtgtttcttggtgaaagtactattgttgcttggggtgagtcaattctttgcagggtgggattctgtgcattgcaggatgtttaacctcatgattccctgactctaaaggccagtagttccccggagtcattttgaacaaccagagatgcctctagacatttccaaatacttccaggggacaggagagtgcagccctggttgagggccactgtggaggaacttgacaatggggcgtgaagcaaggcaacctccaaggtgtgaatgtgttgagtcctctgagttcacttataaattggtggtttagaactggggaatcacgtttgctttatagagatgtaagatgattcatcagtggctggattaggcccagaagcccataatgtagctgagttacatggttctaccagactgggttagtgctgaggggcaggcatcgagatggcaatttcggacatgttgatgagatgattacttgaaaatgtccagaaagtaactagaatctgatcccaggggcaagtgagaggtcagctctcaagatataaatttgggataagcccacgttgaggtaggagttagacctgaggcccaggttccattaaggttatccagggagaaggtgttgggaaagttgcagaatgactccaggataagtccagaggtagagaaagtaggccccagtggtatctcttctctgcctcctcatttctgttcccatggttagcaccctgtttcaggacttcaatttgtgacaggaccactgcagcaatctccttactggcctcctttctgcttttggtctctctgcctgtccgaattttctttttaaaacatggctttcatcatgtcccttcccaacattcaacaagtccaaactgcttagccttgcattctcacccactgcgatccagcttcccaccaacctgacacatctttggtgagttggctccgcgttcccctttccaggttcatggtttatccgtctctcagaccttactgtgtggctacacagaaccccaaatacacactgccttcctctcctccatgctatctccacccctgggatgctctttgaccctctttccatttggaaaaatctcactcaggcatcaaggcccagtgcaagtctcctgcatttccccaacccctcagaggcaggcagatgccttcccacctctgtgcaccctcctctccagctctcgctctgttgcccaggctggagtgcagtggtgccatcacggcttactgcagccttaacctgctgggctcaaatgagcctcctgcctcagcctcccgaggagctgggaccacagatgtgccaccatgcctggctaattaattttgtagagaaaggttcttgctctgttgcccaggctggtcttgaactcctgacctcaagagatcttctcaccttggcctctcaaagtgctgggattacaggtatgagccactgctcctagccatccagtttttcgtatacaccatgggactgcaagtctctcccacaagactctgagggcagtgaccatgactcgttttgctctgcaattccattgcccagcccagtgtgaatggacaagaaagtggggctgaggatgggctggtatggcagggcaaagaggaagtggaatggtctctttcaaacctcaccatggatctacttgagccacttttacctgctctctccctacaagtactgtctttggatgagggtttgtggaagagctaggaaagagaaggagccaaggcaagggacaggcagagggagcagcgtggagaagagaggagatgctgagaggatgaaagagaaagaaagtgggggagagcaaacgtctgcattggtggttcacatacataaaggattcaggtatggtagagtggaataagaaaacatttgggattctgaaaataaaatcagctgctttggcaggtcagctgaatgtacagttaattaataggcattagtgccctttggtgctaagctgtgcatggaaccatgtcctgctgggatcaaatggcagctacccggggatgcccttttaataaagagcagaaagcagcactgccatgtaagagctgcagaatccctcagagagttcttcttaagggcaccagggaccactggaaccccagagttgccccacatcactggcctggctcttgccaaagaaaggtgggcatgagaagagaactaacacatactgagcagctagtatcccaggggctatgccagacacacaaaagctcatttgatctttactgcaactctgtgaggtagcaattagccctgttttacagattagaaaatcaaggtcctaaggagggttaagaatcttgcccaagggcacaccgcttgaaagtcttggatcccagattccaatgaaggtcatcctctccccttgatgagcgggccaggacccagaggttggcagcagtttgctctccattctggctgactttggctgtggggctgatctctttggattgatttctttgaacataaacaaaataccatcagtttttcctggctttggaatgagccctcagaatcatgtgcttttctccagtttccagctgggtgcctttgctgggggagttcgtgaatatgaagcaacaggtctcattctgagaatcaacactgtgcaccaaaaaataccagggtacttttgctcccaggaggtatttcaagctggaggctttcagcctatggggccaagttttccattttttcttccctttcaatgacctgcatatgattgacagttgcctgttttcccaggaaaattataaaatctttatcaaaatattggcacctttgagttgttgcccacactctgttctgactgactgtgtgacccacgtccctatctgctcagtggttggacgtgttctgtctgctgtcaacctgtgagtcggtgagtagaggacaggaggtatggacaggacaggctgcggacagtgttttccaaaattctgatgtgacatgtttaagccaattcgtggaggagccaatggaggtagagtggctggagccaataaggggtttagagcaggggacaaaatggcacccagcaccaccccatggagatgcggctttggggtggggtaagttggctagaaaaccgatgatgatcgttttctggagttgttctggagtcaggaacagtctagaaaccctttgaattgaaccttggcacagagttgtatgtcccacacatgtgatagggtattaggattatcatgctgcatgcaagaccttctgaaatcttgctgcataacagaactttcagtcatacataatgacatgctgaggaataagttgctcgtcttgagtttggccttttgccctggtcattgtagtggaacaggatttttcttcaccaccttcaaaatcgattcagaatctggctacttcctgccacctccactgctatcaccctagtccatgccaccatcgtctctggcctggattattttagtatccctgtcaccagtctcccaaagtgatgctgtgaaaacatagtgtgagcatgtcagtatctgctcaacatcctccacttgctccccatctcactcagattcaaagtcaaaatctttatagtagtccacaaggtcctgcataatctggtcccccttacctccttgacatgatctcctacaaatcccatcgtctgcctctccattccagccacactagcctcctgatcattctttaagttttccaggtacattgtatttgcttttccttctgcctggaatgcttttccccagtatatcaggaaggatccctggagggagtgctcacaggaactgggaaacggttgctgtgtggagagaaccacctgacgggagctatggcctttggcagagggatgccgccaactcatggtgaccctgaacagagagagtggatgactaaataccccaatctcacttttcctttttcttctggtttctttgcaggtgcttcccattggtcaaacctaacccgaagccagagggcaagggagcctgttgatgccatccacacaggtcagcctaccagggtacaagctgtgtggagaagggtggaaaagatgtggacagacaaatggaaaatgtccagaacaactggatatctttgtagttggctccctcacttccttcacatctccactggaatgtttgttaccttttcagtatgtttcagtttgttaccttctcagtttgttaccttctctggccaccatttctaaaatttcaagccccagccctcaacacctcatatcctccatccatgctgtttgttcttcctagcacttaatactatctgacatgtactttatttatttcccttgcctatcgttggctctcccactagaatgagagctccatgagggcagggactttgttctgttcactgctatagtcagtgcctaggacaggacctggcacagagtaggtgtccaataaattgtgaatggataaatgattcacaatggataaatgatgtactctctggggccactctagtgagtctgctctcagccaggcacagctggatgtaggttaccagttgttactcattcctgctgttcacagtttcctctaaagaggctcaactgctgccatgttttcaggtcagcgggtggcaaggcctttgctgcctccggtattgaaacttgcacaacagtttgttgacttgaatcttatggaaattgttgctgcattaattggcatggactgagctttgtgtattatttaagttgtcatcagccacagtgggtagattcatagtcataggggcactggttcttccaggtggttcttccatacctcaaaggtagccttgattgctagtgggcctatttccaaattaggaggctcagtagccacttccttgaggctcacgggcaggggacctgtgaactgggtcctatgaccacagtgttggtgacacagggataggtgaaatcaggataagcaaaacagatatgcatttctagaacaatgtagttgtgtccaggctgatgtttttattatacaaataacataggaataatattcttgttgtgaaaaaaaatcaattcagctacaattcaaatctctatctctccggtcccactctgctccccgaaggtaaccactgttatcagtggagagtgcccactttcttccaaatctctttctgtgcatacacagtttggttttatgtgggtacttaaaaataaatggtgtcacaccatatatactaatctgctttttttcacttaggaatatgtcttggaaacctttctgttttaggagacatatggatctagttcattcttgttttcttaattaaacttttaattgtgattaaattatggattcacatgcagtataagaaataatacagagaggtcccatgtacccttcacccagttttcctcaataatcacttcttgcaaaactatagtacaatatacaagcagggtgttgcctttatacagtcaagatacagaatatttccatcaccacaaggatacttcaagtcatcctatcatagccacgcctatttccctcccaccctaacctcctacttaacccctagcgaccactcatctattctccatttctaaaatacagttgtttcaaccaggttatgtagtaaaatagaatcacacagtatgcaaactttagggattttgttttcagtcagcataattttctggagatccatccaggttgttgcgtgtatcaatagtctgcccctaccccttttccaataatctgctcctttttattgccgagtagtcttccatggcatggatgtatcaaagaccgtttatccattcacccactgaagggcatgtgggttattcccagttttgggctcttataaataatgctgctataaaccttcacgtaacaggtttttatgtggaaataagttttcatttctctgggataaatgcccaagagtacaattgctgagtcatatggtaattgcatgtttagtttaaaaaacaaaaaacaaaaaactgacggccaggtgcggtggctcacacctgtaatcccagcactttgggaggccaaggtgggcggatcacgaggtcaggagatcaagaccatcgtggccaacacggtgaaaccccatctctactaaaaatacaaagattagccaggcgtggtggtgcgcacctgtagtcccagctacttgggaggctgaggcaggagaattgcttcaacctgggaggtggaggttgcagtgagctgagatcttgccactgcactccagcctggatgacagagcgagactccatctcaaaaaaaaaacaaaactggcaaactgttttccagagcggctgtaccattttacattcccaccagcaatgtatgaggattccagtttcttggcatcctcatcatcatttggtgttctcactgttttcccttttagccgttcttctctaggtgtgaagtaatatctcattctggtttcaattctcattcccctaagattagtgatgttgaacattgtttcatgagcttctttgccatctgtatatcttcttcagtgacttgtctatttatgtctttagcccattttctggttgagttgtttgaatttttaactgtcgagttttgacagttctttatacattttagataccagtcctttgtcagacatatggtttgcaaacattttctcttggtctgaagctttttctcatcctcttaacaaggactccatagaacaaaacttgctaattttgatgaagtccaatttatcaattttgtttttttggatgtgttttggttttcaagtataaggtctggcttatatggctagctttagattccaaacactttcctgtttcttcctaaaaattttataattttacatttaagtttctgatccattttgttgattttttttttgtataaggtgtgagatagattatatcatttcctgaggctgccgtaacaagtaactgtaaacttggtagctttaaacaacagaatgtattctctcatgattgtggaggccagaagtctgagcttaaggtgtgggcagggttgcactccctctggaggctctaggagaggatccttccttgtctagtcccgcttctgcgggctgccaatactccttggcttatggccatgtcactgcaatctctacctccatcttcacatcatcatctcctctgtgtgtccgtcttataaggatacgtgtcattagatttaggactcacttgaatccagaatgatctcctcatcttaattatacttgcaaaagctcatcttccaaataaggtaacatccctaggctccgggaatcaggacgtagacgtatcttttgggagggcaccattcagcccactacacaggtcaaagttcattttttggtctatgtccagttgctccagcaccattcaaaaaggctatctttcttccattgaattgcttttgtacctttgttgaaaatcagtggggcatatttgtgtgggtctatttctaggttctctactctgtttcattgatctgtgtgtctgtccctccaccaatactacatagtcttgattattgtagctacataataagtcctgaaattggatagagtgattcctcccactttattctcccttttcaaaattgttttggctattctagtttctttgcctttccatataaattttggaataaacttgtctatgtttaaaatatcctcctggaattttgatagagattgagctaaaactatacataaatttggggagaactaacatctttactatgttaagtcttctgatccatgaatgtggcatatttctttctctatttaggtcttctttgatttctgtcatcagcattttgtagttttcagcatataagcgctatacatatcttgttacatttacacttaagtattttgttcttgagcaagtgtaaatggcactgtatttttaatttcagcatccatgtgttcattgctagtatatagaaatacaatttatttttgcaagcttatcttgtatcctgcaaccttgctaagctcacttattagttctaggaattgtcttgtagattccttgggattttctatgtagactataatgccgtctccaaataggagcagttttatttattcttttataatctacatgttttatcttttcttttttcttctttttttttttttgccttattacactggttagaacttccaacactatgttgaattaaggtggtgagagcagagatccttgccttgtttccaatctgagggggaaagcatttagtctttcaagcattgtgtttaatgttaggtataagtctaatattgcttgatccagaaaaaaatatatatatatttggtgtaagttgtatgtagatgctcaagttaaggaagttccctttttgccctatttctcagagttttttttaacttataataagtgttagattttatcaaatgctttttctgcattgattaatatgatcatgtgatttctattagtttgttacactgattgtgtagaattagcatacaattctttaaacatttggtagaattctccagtgaaaccatctggacctggagattttaaagggagtagttttaaaattatgaatttcatgtttttaatagttatagggctattcaaatcatctatttcatatttggtagatttgggaagtttatatttttcaagaaattggtctgtttcatcaaagttgtcaaagcatgtagcattgttcatagtattcccttattacccatttgatgtctgaaggctctgtagtgatattcatttccttcctgatatgagcaatttgtatgtcttgctagaggtttgtcaatcttactgatcttttcaaagaagcagctctttatttcattgattttctctatttttctattttcaattctgcttatttatgctgttatttttattattttcttccttctgtttgctttggctttattttgctctccttgttctagttacttgaggtaggaacttagatgattgatttgagaccttttttcttttatagtataagcatttggagctataaacttctttttaagcattgctttagttgcatctcataaatttttctatgttgtattttcattttgattcagttcaatgtatttttaaaatttatcttgaaatttaaattttcatatttgacccatgggttattttaaagtgtgttgtttatttttcaagttttagatattttcttatctttctgttattgatttccaatttggtcacagaatacatttcatttgatttcaattattttaaatttgttgacatttgttttatgacacaggatatgtctaacatgttttgtattccatgggcacttgaaaaggatgtgtactcttctgctgttggatgagatgttctataaatgtcaaatcaaatcctgttgtttgagggtgttgttgagttcctatatacccttgctgattttctatctagtaggtctatcccagatgcctgctcagccttctctgacttcaccccagtggggaaatttggggcacctggttatagcttagcaagggtgaaaagctatgttttcaacccctcctttgctggtggggttgggaacgggaccacatatttttttctgtggtatttggctaaagaattagtgtataaaaatttctgtcttggtaagagagcatgatttttaaaaaatctgcccctgttggtattttcagtttgcagactttttcagcttcaactctgggatatatgaggcaaaacaaaaatccagggaactcaccacatgccgttccttgagtcctgaggtctcttgcaggtgtacattcttctctccacctcctctccagtctttttgtgttcattttatatataatgctcacggttttttgttgtgctttagagggaggaccagggaaaagtatgtcattccatcttcccagaagcagaagtcctaacttattcttttaaaatgttatgtaactttgcagagtatgacttttatcaggatttatttaactattcacccattgatgaacttttaggttgtttcttaattgtggtggctaacacaatctttcaataaacatccattcaataaacatttgtgtacacgtgcaggagtttcttcatgatagatgctaagtggcgttgctgggtaataggggatgcacattttccatgttaatgggtgttgtccaatttctacccataatggctgtgctccacccagcagtgtatgagagtagcagttttgctcaacttcttgacaacacttgataatagtcagactttgagttccgaatgtaatgagtgaaagatgatatctggtggttgttatcatttgcctttccttgattcccagaggctgaatatcttttcaaatgtctgttggccatctgtaactctccttttgaattacctgtccatatactttgcccatatttattttgagttgtttacctttttattgatttacagaaattctctatatatttttattgttctttgtctaatacatacatttcaaatatatttccccagtttattatttgtcttttaactttattgatggtgtcttttgcctaaaaaaaaattattcttttgtgtagattcaaatttgtcaaccactccctcctggcttttgggttgtgtttgtgtgttgtttaaaatgactttctccataccaaagtcacaaatatataaatctctatttttcccattacaggtttctattcttttttatatttagttgtttgagctatgtggaatatgtgtgtgtatagtatgaggtagggatctcatttaatttttatcaaatggaaagctagttacttcagcactattcgttgaatagtccattctttcaccactgacttataaatgcagcttttattattttatttaacacctttacatgagttggcttgagagctctctgttctctttcactcatttgtctacttctgtgccaatgccacaccctgttaattactgtagatttgataccttgtataatgtcatccttcatttgttcttttccccaaaaaaattgttttggctcttcttatacatattctttttcacatggattttagaatcagtttgtcaggttctgtgaaaaattcctctggagatttgattgaaatagcaatgagattatagattaatttagggagacatcttttctccttttctccacacaactttttctccttcagaaagaccactggggcctgcacgaaagatgttcaggggtcaaagaacccacataacccatccccaacacacacacacacaaacacacacacagagacacacacatttgtgtctgtgtatttgtgaggacctacacttcaggctctgagggtaaatatttattataaacagaggctctggacacttgctctgctgttcagtggtacttccaaagtaggggcaactcttccttttcctgatcacaaacaaaccaacccaccaaaactctggcttgattacataccttgttgaacttcacagaagggagtgaagagtggaccaagtagagaagcagcatatggtaacattaggagccagtggggctgtgctgttttatccaggagagcccagggtgacagcaagttatcatgaatggtggaggatgggaagtaccagaaattaggagtggcccctgttccatgctggtgtctgtgggttggggtcctgtggaactaggaaacaacccaccccagaagggtgcactcattcatcatgcccctctatataggggaagacgggctgggtagcagggcctattgggcctgaatgttctggatagaccaaattgtgggttcagaggaagttctagctacctttgggtccactgctgacataatactctccagttctgtggagattttgtctttgtggggtgctgacacctggatacattacccttctacaatacagccatgctacctgcccagtggtgtgtcccttcaatgttgccagctggcagcaggtgctcgcagccagctgcacaggtgttgatgcctggcctcaaggtgggactgccagagcagctcaagcttcccactcaggtgctccagcaaattgtaggcccagaaagacattcagtagcgtgaggcagccttggagttaagctggagccctccagacttttcccaaggaggaagtaggggctggcttaggggttctgtggtatgtgcagatgctgtctgggcaagcagcactgccctcacctgtgttccagctaacaggatggacactgcacccagatatctgcgttctccccctacaaggtcatggtcctcaaggcaggaatggggtctgagccaccagcactactctatggacctaactgtctaacaaagctggcaaaatattactcagatagaaggcagaatcaattgtagtagatacctgagtagaagtacaaagtgatgtatggattttaattgccccactttttgaaatccgatctatcactaagtccttcccattcccagatctgtaatctttttttttcccctcattttcctgactctaatttagaccctgctgagcctgctggggtctcaggtgctactcctccaatctgttttcctttggtgcagctttcgaactcacagctctgatcactgccctctgccctatataatctaaaacatatttacagaatcaagcccaatgcttacctgactttcttcttaaatgccatttatagcttttcttttctttctaaaatggtaaatgtttattatggtgcttgactttcaaggacctctatgaggtggtccaacctacccttcctttgcttgtgtgggggtgaggacctgggaggttagggggaccatgcagcttgatgctatggaaagcacacctcgagctctggaatcagaggttactggttaatctaggccctcccctgcttcttatctgcttgaccccggccctcgcctcaccgttcccccgcccagtttccctcttgttaaggtggtgtgataaaaacgacccctatcccgggttagaggtgaaaactcaacgcgacaagtggaggagagcgggcttttagcgccagaagcttccatgatgcccaggtccgcgggcagggcgagggcacgggccggggaagcaagcgttgccgcgccgctaccgtcgggggccggcccccgggctgcttttcgtgcgcggagcagctcggccagtcaccaggcgcgtgcggaggcggcgagcctgcgagggcggccggtgcgggcgcagccggcgcgatgagtcaccatccctcagcacctccggaacacgaggctgcttggaagcagccgggcccccgcccgccctcctcccccgccccgcggagtggcggcgccagcccgatgcccggcagagggcgctgcagtgcggctgcggggccaccggcccgcgctgctctggctgccaaaggccggcgctgcctttggctcagagggaaagatcggggcccagggatggggtgcgtgaggaatgaatgtttctgcagtgccagaggtggctctgtttttgatccagaaacgaaatggacttcaagattcagacactgggcagagtgatggggccgacacggcccctactggagagtgtccagtcttgatcgccccaagcttttgagcagggatgtcctgtccgaggctggtgtcgtccccactctcgccagagaggatctgtgataggatgagtctcgcctttccaaaatgaatctgcctaaggacccagtccttgatctcctctgtgacctctttcacctgaggtgatggaggttacgaagattggagctgtctgcagtggagcgcaggagaaagtgcacaagctttcgggtgaccagggtttcagtgccagctccatcatgagattgctgtgtgaccttggtcatttcattattcattcattcattcagaaaacactcactgtgtcacaaggcactcacggtgaagggaagagaaggaggccaagcctgtggagacaattgccctgaccataaaatagcttaggccaggtacagaaacccgacacgtaggtaaacactggctgaatgaacaaatgcgatgatttagtcaccacacactagggcagagatttttggtcacttatgctcccgagtacatggaacagtgcctgacacacagtgggtgctcagtaatttgtcgaatgaatgacagaggaatgtactgagtgttctgtgagcacagcagaggccacctaactcacaagattctgtgctgtttgaaccgagtcttgaaggaagggttgggattagttaggcagacaagggccagatggagggtgatacaggcagagaacagcctgtgcaaaagctaggagtcctcagagttctcacctctctgagcctcagtccctcctgtgagaaggaaaggatagggctggctctgtaatttctcagatttttctagatctaaggttctcagattcaacaaatgaatccagttaccctagtcagagcctgaccagtgctgggcagtccaagagactcaggttttgacttttgactcagcccatctgcagaataaaggcctggtgatctcaggcaccccttctccatctgcttcctctgtctttcaccttagaaatctcccctgaatcctatccccataggataaactatctgcagcacaaaagtcagcacttacttgtattctgccatgatttttcttcgtgttattttttgaaatagtctttatttacagatttttacactaacacaggctaattgtgaaaaaacaggaaagtacaaagaagaacataaaaactctccgtaatttcactacctggcatagttccttgatttttttatgccttcattaaaatacacacacacacacatacttcagctcacacagcagcactgacacagatcgctgtgagtcttgtgttcccagcaaaagcatgagctggggacagttctctctttctctccattagtttgtctctgatgggaagagatgttggctgggaccccaaaactctgactctttaaccagctgcagatcatcaggctaaatcctcaaagaacatactgctcagaggacgtttcagtctgaggcagggctctggacgcaaaccactatatggcctcttcttccttcctggagttgggctagggttaagctagattatgtgggggccactagccctgctttggtccagaccagagacagtgctgagcagctttctagggaggggggaagggagtgctctgggatttactgccccacctgtctgagagaagcccccaaaataaacccataaccctagctgacttggtttcccttggcccctgccgttttaaagctccatccccaacacagtggctccttttttgccctggttccttgcttttcaatgtgtaacccatggaccagtgacatagaaaacaagatctctagatgatggtttgtatgttgactctgagaagcaaagtgcagattctgtttcagaaggtctggagaagaacctgaaattcttcattttgtaacaaactctcaggtaatggtgacatagctggtccacagaccacactttgagtagcaaagatctagattcctcttttgaccttgtcttctctgaaagtgaaagggcaggggaaactccctagaggtgagggtgtgtacacacacacacgcgtgcgcatacacacacacacacacacacacacacacaaatattgaggactatgttctgggtgttcagtgaatgcttgccctgttaatgcagaaagctgaggagtgagaagacttaaagctgtgttcccacctctccaatcacttattcatttcagtgatgatagcatcagtttctcagtcaccaaatggaattggttccttagacatttttgccctggctctgcctctattttcttattgcttctattctcagacacttctcatctatcccctgccttcctgtctgtggtccctttccctccagttcactgcctgtcacccaattcttgttacccaaatccaacttaaaatcactggacgtgtgtgcttcaagggagagtaagtgggcagagaaagggagcttctcctcagggcccaggtaggccttcaaacttcccttactctgaatctatactggggtagcattattattccctaggaaactgaggctcagagacattgagtaacttgtccaaggtcacacagtgaggaagtcagaattgagatacgaatccacatctctttagttttaaagcctgggctctccacgatatcatcccttcatcttactcagggggaagatgaagattgggtgacttaaggtcattcagggagtcagggatgggactgaggctggaaactcccttcttctgacactgtaagtaaattttcattcggtagctcctctgctcagaagccttcagagaaaccctcttgcctatagaattgaaacttctgagcctgacagccaaggctgtcatggtgcccctgcctcagctcggcttctccttcttccccagcactttacttggcatgtggaggtgctagaccatctctcttttcctcacctaccagtggggttcttccctgaatcctgttcctccctagcctcagtcatgccttagaattcctctaccatggtgcctctgctctctgggatattttctcgacctcaaacacccaggcactctacctgcttctcagaatctttcccatgcttcaagagcataggttctcacccctctgggaagccccccacccaccaaagctgccctgagcccttagagccttgagctaggagcctgtcactttagcagtgctgccgcctgttggtggtttgaagagctccaccccaactcacagatgaggccaataaatattattatactataataagcctctgcagctataccccatggcttgaagaactatttccagaatctttcttctccattctgaacttgctttcattactttaatgtctcaacccatttgggctgctgtaacaagataccatggacatgtggcttaaacaacaattttttttttcttacagttctggaagctgggagttttaagatcactgcacccatagatccggtgtctggtgagggtcctcttccaggtttgcagatggcccccttctccttgtgtcctcacttggcagagaacagagagaggaagcaagctctctgatgtttctttttgtaagggcactaatcccatcatgagggatccaccctcaagaactaatcacctcccaaaggccccatctccccgtaccatctcactggggagtagggtttcaacatatgaagaagggtgcacagacattcaatccatgacacttagtgtgtctaggtcctagagaccgtatctggttttcacaactttcccagccctgttagagtctgaggcttaacttaatccccactttttgatcctagatgctgcttcagatcaccccacctccatgacttacctattataccttgcacccaacagctctttgcattccagcctggatacagtaccccaggtccctgcttggcctgaaaggaaagtcaaacatggctgcctggttatccattcactatttctactactttctagatcttgtcttcataagtaaactctaagctcctggaaggcaggactgtctgtgtcttattcttttctttatcctttgcaataccagcattttcttttattcattcatttatttcttaaagactgaatgttcattctctgccaggcttgatactaggtgttggggcagcagaggggagacaaatatggtctaatatattctagtaaattcaaggcaacagggaagtccaatgacataagattggcaaattgactttgggcccaggccagtagaaatacgtgtgaaaatggttggggaacaggcagggcctgcctatgcctagaacagataaggaagaaaatcaggctggcggatgctggaggcctgcttcaagaaccttggggagaaatgggagaaggagatggagtattgtctgctttttccaaaatgagtgcctagaaagggaagtggcaattatggtcctgatgaaaacaatatttccagttgttacctgaaacaataggatctgggggtgtgattctcagaggtgggtgatgtaatgggaatagcactaaactaagctttctagccctcaaattccatgaccctttgacctgagttttggtttcagctctacctcttgttcactatcagacttggctagctccattcccctggctcagcctcagtttcctcctctatgacatggcaggatgtggagtggggtggtgagtgaggagcttggactcagggactgcaagcttcctctgagctcttgacattcttggcatgcaacaggaagagaagcatggattaggaaggttctattggaggttgagactggaggcagggaggctggtggggaggccgaggcagcagtgccagtaggagtagagtgggagagggcctgagccaaggcaggagctgacagattggtgacatatttaggaggaaatggaaccgacgggaactgtcaactgatgagatggtgaggatgaaggaggaggaaccaaagaggatggagatttgactgtgccctaggaggcctgagggagaggaatcttgggtcccaggcctaacactgccaacaagcttccatgtgaccttagggtctctttctgtttcagttgccacatctgcacagtaaagagatggctctgatgctccctaaacccctccctgacccctaacaactataacaaattagggagcgctgtgggtttccaaatcagtctttaatttgttagaagtttgtaggaaaattctgaactcttacacaggaagctgagatctatggtagggcttgtaactataatggtttggtggtgaggtaaggacagcgactgaggctacaaatggggctaccaggagaggccctggggacttctcctcaggtgaagcccaagagttggcagtccttgaaacacgggcttacttcttgacctaggaagatgtggccttggcagtattttaaaggagacatttgaagatcccagatcccaaaagaatacaaatggcacagtactctgcatggtgtttgagccatttttgctggttcattaactcatttcatcctcacaggtaccttcatttcacagatgaggacgggcacagagaggctgagtgggtggtctagatcacatagctaaagaacaaaagagcacacaaagctgtttctggggcagtaagccacagtgctattagcagcatctgtgactgtcactactagaatcacagctattttcatatcacattacggttgtggcagggatctcagaaaatcatctatgctcatcaccacttcaaaatgataatagtcattagacccactgcttgatcgtgttatattgaaggtgttaatcaagaagcacatatgactatattgtaaattgcatctcaagatacagtaatcagtttcctttataatcctaggtaatttatctaatacatttagaagcattttttgaaatatgcaatacattgttattaactatagttgcctatgttgtgcaataggacaccaaaactttttcctcctctctaactgtaacttagtgcctattgaccaatgtcttagattttaaatattctcacacataataaatgtgtgataaatgatcataatgatacctatttgaggtcatggatatactaatttccctgatttgaccattccacaatgtatacatgtatcaaaacctcacaatgtaccctataaatatatacaattatttgtcaatgaaaaataaaataaaactttaaaaacacaaaataatagctactattttctacccccaaagatctcccacctatttttttcctagaaagggtccctaagccgtgccagactgccaaaggcatgacaaaggggtccacgccatggcctagaaggcactcctgatagagggtgggctggaggcttggccaggctctgtaccaggcacctcacctatgcactctcacctcaccctcccaactccaggaactcggtgtgattatcccacttgacacacaggagaccagcgctagacaggagggaagccttgtctacagtcaccagcatgtaagtgcggagctgggacacacatccaggtctgtccgaccagagtccattttgtaaccactgcagctctctgtctcctctggaaggtgactgccagcccttaaatggagttccctcaaaaacaaatgacccatttagggcaaaggacacctgagtggaaactaagtgacaccatttttttcagccccagtgcacatttccagacctggggtgtggaatgagggctcttccaggtatgaagggaacgtcttagagcagtactcggtttgatgcttggcagccagggcatagtggttgatggccagctgcatgcctgagttcaaatcccagctatgccacttgctgtttgtgtactcttggacccattgcttaacctcttgatgcctcagtttcctcaatgtaaaatgaagttactgataatatctcctaaggtggtcctgaggattcagtgaagtaatacacataaagcacttggcactgtgccttgagctgtggtgtgaaccagtgccattattttctcctaagagagtaatgcatgaaggagactcagggctcctggaagacctttgacgtctattaaccctttgtcccttccccgtctgttatcagggtctcccctgcccgattccctgatgtatagacagcaggaacctttaaatccaatgttcccatctgtggctgcacattaatatcacctggggagcttttgaaatggcgctgcccaggcctcatcccagactattggaatctgactctagggatggggatggagttggagtattttttctgcagctcctcaggagattctaaagtggagacaaagctgagaaccatggcctcagaaggaaaagggcctgtgtgctgctctttggggacaacaaggaaggaagaagaaactcagagatcatgccctgctctgcagacaggatgaaaaagaacagaagcccaggcatggggaggaggtgggcagctttaagctttaggaaacagtgggagctggagcctgcagcaagaaagagctatggggaaggcaccacagccagaggctgtcccaggccctgccaggccaatggcctaggtggttttcctgcagaaggaaatgggaaatatggaggtgagggcgagataaggttgtaaggatgtactcacagcctctttctgcaccctcaaatggcagatcctgataagttgttaacaccttgtaagaaacacgagagacagtctgttccacctcctcccctggcacacatacaaaatgactccccatctacccactcataagatcacatccggattccaccatcacccaacccagcagaaagtcccacctctggtctctgtaaatatctgccagccagagcagtacagcatgccagggtcagacaccagttccccaagtgtgctaccttttgttataagaggagacttcagcaacttgggagctgggcagggctgcagtgatgatcttttcaatgtgtgaagaagggaaactgtgtttgagaggagaagaggaaagtggttggcctatggtgccacagggagtagcagaagagacaggattccctgtccagtgctcccttccctacacaccctgagacttcagctttggtccctaatctgccagtgccaggaaactggcccacttcccactacagccctgtggctctgacagggtctctcatgatatccagcagagatcttgagtcagctgctctgaaggaacttccagtaaggctccagcttggagtctggatcaggagttggggcatggggcattttgagtttcgtgcttatgttgccttccccccatcttttgctcctggacatcttttggctaggtggggttttcctcactccccacctccaaagcggagactatgtctttaagaaaggacgagtcagagccgcggggatcagtttcaagcagccctcagaaggcgaatctggattgagtttaggaagaaaaaagaaggggttagctttggtcctgcctcctttcctttctctcatttgctcgtctctcctccgtccttcgtctggaaatttggtgaacttggccaggaggttccagagcccagggctttccccagcagcctcgtcctctcacctggtccctccttcagctcctgagcacacagtttggaggacagctggacaagtggctggaatgagtaggtacgtggtctggacattttaaccttcaccctgtcagggaagtctggggagtgtccaacacagaccctgtgggaggcggaagggaactctcaagacctccgagaaccttggtaaccgaggcaggaaggagatgggtgggctttggtgactccactaggggttttgtattaagggtcagaaggaggcttggtccatgcagcctggcctacctccaccctcgtgagttgcctaccaaacccatgatgggtgggagtttaggagtgtgaggtgttgagtttgctgctgctgctgctgccgctgctgctgctgctgccactgctgctgctagaggaatggaggccagagggtgctaggaaccctatgagaaaagcagatggcaacatgtccagccccagccatctgtgactctggtggcatggaaccactcagctaaggtgaatgggattcagtctgctccagctgcatgtgcagtgggccaggagccactcaaggtcttcttgggcttacttttttcaactttgttggatgactacaagcaaggcttttagcttttaaggacttcagtttacacttcagggaaaatgacttaatgctactcagctgaaagggggaagcacaaaggaagaggtagagaaggcaaactgggtttgtgatagagattcaaggagagctcgagatttctgtgagctcaaggatgttttcccctattattttaggaataattcattcatttatttgtgtatttaatcagcaagcatcagttaaatgcctattggtgcccgtcactggtgtcagggaaccagcaatccaatatggcagcaggtccttccgcctggcctccttccccagatctctactcctccctttccctcacccctcagctgatttgagagaggaaggggcactagcttctagtgtactgaggtgacatgataaggtcatgataggtgctgacattgttggcactagagtgggtacatctcatttgacaacactctctcttgaaagagatttgggcctgggtcccaaacattacctcagccactgggaaggattttgaaggtcaggaaacaacagggatccacaagttcagcctaacccctccctgacagaaggggtggcccaggccttctttggacattgtcggtagagctgggcccctggttgggtcctcagcatcatatgtggaccaagcgttgtttggatttgccaagaacatctaaggactttggtctttgtgatttaagtaagttgtcataacttgggcaggaggcatgctgggatctcagccacctggctgttggggaagggatagggttgggaatactggctcttgggtggtcctttgggtgtggaaagcttaggcatggcatagacaagcatgtatgtgtgtatgatataggaagtatcccccaggagaaaaggcccggcaaaagcaaggcagagtctaaccctgtccaagtagggttggggttcaggactggagtcataactggcagctcacacaaggacctaatgcatacagaggaagggcagtgagaccaatgccagcgcctgtgtactctgctctcaccctgctcaagcagaaatgggagtggtggagccaatgggtgagcttcatgacttcagctgagagggctgaattggcctgctcggggctgccaccaccctacttaaaaacaaatcctcatagcccagctaccactgcactgggtgtttgcgactgaactgggcttatctaaagggttatttgtgagcctggaaaagggatagggaataggccatgatgtcctgaggctatgacagtagcactttgctaacttatccttgtccacccttccaatcccactgtggctgctcctgcctcctcaggaagggatacctccaagctcaactgcccactcctgcaggtaggcctactgccctcgcacatgctctgcccacttcttggattgctgggctctggctgcaagccctcagagctcctgtcattcctttgcagaacaaagcagctactccaagcaagtggtgcagaagggtggctggtggaggggaggcggagaaaatgtcaggggcttatgtcaggaaagttgaatgcttgccagcagctgggccttcccatctagggtgacttcatgaaagaagcccttgaaagattgttccctctcccttgtaagggtgcatttttgggaatcactttgttttcctctccattttctctgcaagtctgattgtttgaggagagctaaacgttatgtgtactattaaagaaaaaaaaagtggagaaaaccaccccttaaatgtaaagctgagtaatttcaggaaaggaatccaagggaatgaggtttctgcccaagtatgggaaaatatccatccatctccccacttaatcagaaaaatgatctgccgaataatgagtcatgctgcctgtcagcaaacagcactgaccctagccacagagccaggaataacagaggtgagagatgacagtagctatgacgaagaaaagacatgaagggaactggattcctgctgccagcagctgtttggctcacctttgccccgtcctgtgcaataaaaaatgcactggactgggctgtgttattggtgacactgatcaataccactggggttcatctgtgcattctgataagtggggtctccgcagggggcactcagaatcaatcacagctttgtgcacagtctgggagttcttttttactgaggaaagcatatatacagtaaattgcataaagcacactgtaaatgtacatttcaatgaagttgtatatgtatatgtgtgtgtgtgtgtgtgtatacatctgtgtgtaaccaccacccagatcaaaatatagaacattcgcagcaccccagaaggcttacttttgccccttccatttggtatttacacgcaccaagtgctgcaatcaaatgtttgtgatcagtggcatgctggtaaatgtttaacaaccagttctggtgtgtgtaatggggtgccctgctttgtagcttttgccaattttgtggtataaatattcctgctatggctaatttcgagctaccaacagtttaacaactggctcacaaaattatgaaaatttaacaattggctctggtgagccaagcagactggctccagcacatcaccagttgtaacaaaggattaaagagagccaagtccacccaactacccaatgcaggtaggagtgggctcccaaatactcccagttccagcccccttagtgaggagagaatcgttcataggatttaaagtgatctccagcttcttttatgcagcagacatcggttgtgtccctaccttgtggcaagctctaaggtcacgaacatgagtaaaccatggttctatccctcaaggagcttacataatttaacactcggaaggagaggcggacgtgtgaaggtatatgtgcaataaagagttctagggtctgtgtaggagactgcatggggcttaattgagggcaccaaggagggctcatttctgcctttgaatcagaaatacatctcttattccactttgctttgggaggtgtcttggggccgaggaaaagagcatcagactcctacacacctgttttggatcctggttccacctcttccatgctgtgtgatcttgggcaggtcacttaacctctctgagcctcaggtcccatatctatagaatgagagtaattgtagtacctaccttacacagctattgtgagtattaaatgagctatttcatgtgtagcacttagcacacataagcacttactaattattagctttaattaggaattattagcttcaattaagaattattaacaactagcttggacaagctttgaacctctctaggactcattttcatctgtgagatgggattaaagtgccaaccttgtcagtgttgtcatgagaattaaattagatcatgtatgtgaattgtctggcccagagctggttctcagcaaatgctggtttgcccctttcctgctttctcgctcctttccaacacactggcttaagacctcgcttggaaaaaaaaaaaaaaaaaaccagttctgacatgttaggaaataaatatatcaagtgaacacattaaccctttttaaaagctttttattttgcaattttagactcaagggaagttgcaaaaaaatttacaaggtggatctggtgaccctttactcagttttacaatgttgacatcttacacaactgggaaagtgatgttggtacaatccgcagagcgtattcaggtttcacgttttacatgtcatgtactctgtatatgagtgtgtatatcatttcaaacaattttatcacatgtatagatttgtataaccatcacaattgggatgcagaacttctagtaactggccactgaagtaaaaaaaaaaaaaaaaaataagccaggcgcggtggttcatgcctgtaatcccaacactttgggaggccaagttgggcggatcacctgaggtcaggagttcaagaccagcttggacaacatggcgaaaccccatctctacaaaaaaatataaaaattagctgggcgttgtggcagggacctgtaatcccagctattcgggaggctaaggcagggagaattgcttgaacccgggaggcggaggttgcagtgagctgagatcatgccactgcactccagcctgggcgaaagagcgagactcagtctcaaaatggtaataataataataaaaaggagatgcagaactgttgcatcaccacaaagatcttcctcatgctacctcttggtatttgtacccatctactacccactcccctcatcagctaacccctggtaagcaagaacctattcttcatctatatgacttttttaatttcaagaatgttatgtaggccgggcatggtggctcacacctgtaatcccagcactttgagagacaaaggtgggcagatcacttgaggtcaggagttcgagaccagcctggccaacatggtgaaacctcatctctactaaaaatacaaaaattatcctggcgtggtggtgctcacctgtagtcccagctcctcgggaggctgaggcaggagaattgcatgagccgtggtgtcagacgttgcagtgagctgagatcacaccactgcactccagcctgggcgacagagcaagactctgctcttaaaaataaataataaaattaatcaatcagttgggcatattttgtgggtctatttctggattatctgttatgttccatttatctgtttatctatctctccaccaataccacacagtgttgatgagtgtagctctatagtaggctttagcactgagtaattcctccaattattctcctttttcaagattgttttagctgttttagggcctagtgcctttccacgtaaattttagaatatagttgtctatatctataaaaagaaaaacgttgtgggattttaataggaattgtatgaagcctataaatcaatttgggaagaattgacttttttttttttttttttttgggagacaaagtctcggtctgtcaccaggctggagtgcagtggcgcaatcttggctcactgcaacctccgactcccgggttcaagtgattctcctccgtcagccttccaggtagctggggctacaggcgcacgccaccacgcccagctaatttttgtatttttagtagagatggggtttcaccatgttggccaggattgccttgctctcttgaccttgtgatccacccacctttgggtcccaaagtgctgggattacaggcgtgagccaccgtgcccggcctctgaattgacatctttactacgttgagtcttccaatccacgaacatagtatgtctgtcctttatttaggccttctttcatttatttcaccagcatttagtcatattcagcatagatatcctatacaagttttacacataagtgttttattttctttggaacaactttaaatggtattatgtgtttttaatttggttcccacctggttagtgctaatatatagaaatgcagtggtcttttctgtgttgatcttttatagtgcaaccttgctgaagtcatttattagttctaagagtttttgtgtagattgcttgggattttctatatatatataattatgtcgtctgcaaatagggacagttttattccttcctttccaatttgtatgccttttctttctttttctagcctattgcaccagctagagcttccagtattatgttgaataagaatggtgaaagtagacatccttgtcttcttcctaatttcaaggagaaaacagtcttccaccattaagtttaatgttagctgtagggttttgtttttgttttttgttttgttttgttctttaatagatgttctttaccacgttgaggaagttcccccactcttcctagttttccaagagtttctatcatgtatgggtgttggattttgccaaatgatttgctgaatccattgattggattatatggttattcttctttagcctgttgatgtagtagattacattgatttttcaaatattgggtaagccttgcattcttggaataaacctccactagagtaaaatacccacttggtcatggtgtataattctttttatatgttgctgaattctatttgctaatgtttttaaaacatttttgtgcctatattcatgaactatattggcctgtagtgtttttatttgtataccgtttttgtctagttaggtatcagggtataatacctcataaattaactgaggagtgttccccccttttctattttctgtaagagactgtgtaaaattggtgttaatttttctttaatgtttggtagaattctccagtgaaagcacctgggcctggacattcttttttggaagcttttaaaaattgtaaattcagtttttgaaatcactataagatttcacattcagattatttatttcttgattgaactttggtagtttgtggttttgtgatattggtctatttcttctaagttgttgaatttatgagtgtaaagttgtttataatatccttttaaaggcttcagaatctgtactgataaccctgtttcattcctgacattggtgatttgtgtcttctctctttttatctttgttattcttactagacatttatcaattttatcaatttatttgaaaatgaacttttgtttcatggacttttctcgattgctttcttattttcaatttcattgatttctgctctctttatttcctttattcttcttactttgggtttatctttctcttcttattattatacattcttatagatatgaagcctttcttcttttctaatgtaaggatttggtgctataaattttcctgtcagcattgctttaaatgcatcccacaaattttgatatttgtattttaattaattttcatccagtccaatatatttttaaaatttcctttgagtctttctctttgattcatgggttgtttagaagtgtgttgtttaatttccaggtgtttggagattttccttttatattttaaaaattgacttgtagtttgattctctatgtcaagagaacagactcagtgtgacttcaaatatttttaagtttattgagatttttgccttggtgaatgttccatgtgtattctgctctcgttgggtggagggttctttgtatatgtcagttacatctctcggattgattgtgttgttgaattcttcttctctttgatgattttctgtctagtatgtctatcaattactgtaagtggagtgttgaagaacccaactataattgtggattcatcaatttgtcctttcagctctctcagtttttgcttttttatttttattttttgacacggagtttcgctcttgttgcccgagtgaagtgcagaaactttatctacctttatgcccttttagcctcccttatttataattatcttaaatatttcctctacatacatttagaaccacataagatagtatttgcttcaaccatcaaatataacttagaaaattcaagtggaaaagaaaaaatctattgtatttacccatatttttgcttactgtgttatttcttccttcctggtattccaagattccttctttattgtttcatttatgtttacagcaggggtccccaacccccaggccatagatcgataccagtctgtggcctgtttggaaccgggcagcacagcaggaggtgagcggcagggcaaggaagtattaccacctgagctccgcctcctgtctgatcagtggggcattagattctcataggagcatggaccctactgtgaactgtgcatgcaagggatctaagctgcatgctccttatgagaacctaactaatgcctgataacctgaggtggaacagtttcatcccaaaaccatccccctgactcccatctgtggaaaaattgtcttccatgaaaccagtccctggtgacagaggatttcctttagccatgtttccagggtaggcctggtaacaaagtttcttaatttttccttctctgagaattttttgatttccccatcattcctgaaggatattttcactggatataggattctgggttgacaactcttttatttcaggatgtgaaaaatgtgtcatttttttctggcctccatggtttctgatgagaaatccactgtcagttgacttgcttttccactgtgagtaatcattatttctctctgactgctttcaaaagtttttatttatttttaataaagaaagtttaattatgacttgtcatgaatttcttcgggtttatcttacttggttttactcaacttcttgaacctggaggtttgtgtcttttgccaaatttgggaagtttttagcctttcattagtcaaataccttttcagtctcattttatttctcctctccttctgaggctctgatcatacaaatcttagatctttttttttctgtcccacagctctctaatgctttgctcatgttttcttttcagcctttttttctctcatgtttatatcatgtaatttctgttcctctatcttgaagttcactgatactttcctctgtcttattctttctgctgttgagcccatccactgagtttttaattctgttattttatttttcagttctataatttccagtgtgttctttttgatatcttctattactttggtgagctttcctatttttatttttttcaagagtatttgttgaagcactttatgatgaatggtttaaaacctttgcccaataattccaacatctgacatcttggtgttgatatatgttgactgtcttttctcattcatgttgtgattttcctggttcttgatatgatgagtgatttttaaatttttatcctggacattttggatattatgttaggaggctcttatttcagtctcctatttcagtaggcaggctgtttaggtttaacatgtaggatcggctgggcacagtggctcacgcctgtaatcccagcactttgggaggctgaggcaggcagatcacaaggtcaggaaatcaagaccatcctggctaacatggtgaaaccccgtctctactaaaaatacaaaaaaaaattagccaggccttggtggtgggcgcctgtagtcccagctacttgggaggctgaggcaggagaatggcatgaacccgggaggtggagcttgcagtgagccgagatggcgccactgcactccagcctgagcaacaaagtgagactctgtctcaaaaaaaaaagaaaaaaaaacatgtaggatctggcctacttttgtgggctgtggttccaatgacaatttagtttttggagtccttgcagtgctattctggtctcctttgtacatctggtgcagctgcagctccctaacttggtccctactgatgcttcacacaggggcagaatgtacttacccaggactgatgctggtaggtgggggtggaagataccaggcctgtgagggaagaaagctcttcccctggccaggtgcctgtgaaactgtcacttgatttctaccagtgcccccagtgttggcagaaggttctttcctaggcctctcactgagttcctctaggtaagggatgagagataccgtgttgcagggcagagggtgcctcacctggccaagtctctggatagcctggtgccaacagagctcccattctatctctgccagtgccaccagggaaagaaaggccaccttctgtcactgggtggagggctgggagacatcagatctgggttgccttctgccagtgagtggagggtcgagaaatgttgatcaaccccctttttaacacagaatccaaaataccaaaagctcaaagaatccctatttgtttcggcagcacaggactcatttccaggtgcaaggtatgagagtggggtctgggagtctgggacctagtcacatttcttgtctttggacaagtcactttgcttatctaggctcaagtgtctctcctcagcagaataagttgcaagtggcacctccttcccacggttgtgtaaaggtttaaatgagctgtggtctgagatgccgcaatccctatgcccgctgtgcaggcccttaacaaaggggtatgggtaaaaggttgaggcagggcagcctgaaacatcttcttctccacattttcaaaattacaaactctttcaactctttataaacagtcaattataaactctttcaaactctttataaacagtaaagtagggagaaaatgtcagatcttcacattttgccacatttgcttcagatcttttctaagaaacaggtcattatacatccagttgtgagctctgcccctaccctggcctagaggtagccagtgtcccaaactgtctgtttccaattcccatgcatgtatttatattttaccacatacatatacatctataaacagtatataatattgttttgcatgttttaagctgtatataaatggcatcatactgtgcatacatgttctgcaaatttctctttttatgcaaatttagagtgttatgattggtccaaaagaagactggccaagcaatagagattagacatgatattcatgtaaaggcatttgatatgagtagagagcagaaatgtgtgaataaagatatataataatataagagataaaataggacataatggtatatataggagataaagatatcaaggtatataacaacataggagataagactaagtaagagaaccaagaaagcagagagggtgattagctgtgagaaaaaaaacatacagaggccaagataccagtttgtagaagcagaagtggattggctgcccaaagaagcccttagttgaaggaccttttctcctctgctttcctttccttcccttcccttttccttcccttctcttttcttttcctttcctttcctttcctttcctttcctttcctttcctttcctttcctttcctttcctttcctttcctttcctttccttccttgtctctctttatttcaattaggaaagggaaagtgatcttgtgcaacacgactcttagggatagttgggaggattagagtagtctcaacctgaatttgcggcttgtgtctgaactttctctttttaacattatgcttttgagatttatccatgttgatacacgagttagagtttagtcattttaactgctgtacactattccatgtaatggctgtaccacaatttatttaaccattttccagttgttagacatttaggtttcctccagtttttccctgtttataaacaatgatgctatcaaatgcctcttgaagcatttgagaaagtctacaacttcaagttcagtcaagtgtagtggcgtacacttccaatcaataatcccgatgatgtggtgtctgtaggaaatcttggtaaggtccattaaccacaatctggcccattttggttggatgggagctcgttgcaccaggtcagctgcgtcctgtgtggagttgtgggtattgaggactcagccagagaccccatgatacgtttaggactcatgtgtgcatcttctttactcattctcaatcccttggcctcatctcatctcattgtggcctgttaaaagtcctttagtccctgtcactttcgtgtccacagtctgcagtacatgacatacccttggtgtccctccctctgccattcttcatttgttagcctgcagccctgtggccccaggaaaggggaagggcctaacatttattgagctctactctgtaccccaacaccaagttaagtgcttttagatacctcgtctcattaatggtcccagccacccttccaagtagttattatcatttccattatagagatgaggaaactgccaccaaaataggttcagcaagtgcaacattcatacctatgggatggggattggtgtgaggcagagttcagcttggggctacaggcagcctttgatcgaggaattgagtttatctctctctttggggttttgttgaccatcctgtaacaggagacactcctgttagggaatgtgccctaatgttcccttgacagggtaagcccaaggaatcagcgctggatgggaacacagatcatatccatgctttgggatcacagttccacatttcatttaccataccctcccactctctcacacacacatactctcttactaactcagactaacaaacggccctaacacttattaactgtgtgaaatatgtcacttgacctagaggtaccttgtttaatcctcattcacactctgtaatgaagtatcgtgatttccatttttttcaagtttggacattgaacctcagagaggttaagttacttgccctggatcccagagctaggatgtgctggaggccacattctaaacgagaatgatgtgggtggtccctggagcactccaaccacaaactgaagttcaagtgtcactctccatggtcagatgagcttcgttattttattccaggagcatcccctgagcacgtgcagtgtgccaggctctgtgccaagcactcagtgccaaatgagattgactccacagagctgtcactttggggaaattagaaatgctctgatgccacccaacttgcttctggccctcataaaagaaaagtgctttataactccctgttcatcccttgagtcagtcagtcattgtatcacttactcaacaagcattcgagtgttccctgtgtaaaggccctgcgctaggagctggagattcaaagatgaggaatgcccagtccctacccttgagaaacacataatttagaagcagaaacagacatataaacacataattataatgcagtggataaatgatgacagagcgttgggctagatgtagtgagaattcagaggaggaagtccctaactttgcttgcatgagttaagggaggcttccaggggaagggaggtttcagttgggtcttaaaggatggatagatgttttctaggtaggctgtaggatggcattgcacacataaaggcgaatatggaagtctgttttgggaacagtaagtagctgatataaatcagggatctcagctgaaggctaagagggcccaggaagttaacataagtgagtgaagcaggtcacatacaaagatccacacgaacattatcagtggccctccgtgctcagagtaccatagggatgtgtgcggaccgtgggaaactggagagtctgcaccctgtctaagggaacagctgctgctgagctctgctgctagttgtcatatggaattactggcccagtgttgctacattttccagttttacaagagatgccagaaatccagatttctaaaatgtaaaatattgtcgcttttcaacattgacaacgatttcacatttgtaagctacaccatcaaaacatgtcttccagccattcctctgcagcctcaggagagtggagggggctggaaagaaatggaactgggaagggaaccagggccaggcaccctgctcttctcctccgcacacagtccagaccctgggtgatgcagaagttcagccacctgactttcaaaatctgcttttgaacagaagacagcacaaataaggtttaagaaactggagaagaaaacaatcaggggagggtttcatggcatgtccctctttccctttctgggtccaaatgttttatgtatggctcatttactcattggattctggcccccagctataaattctctgcaggccatggctggggtgggatgaaagctaaaggaacatgagaacggtgaggtgaggtcgtgcgctcgggagccacccacgctggatgctgctagccttctgttttcccgcaaccctcaggtctgggtttccctacaaggtctgccagccctgacagaaacagctgctacagatcccaagtgctttctctctgcaaagcaggaatacactggcctacagtggagactggaagtgtctggaggccttgtctggggacaagggccttgcaggcatcatggatgaagccaccctctcaggccctgcccccagatgttctacttttctatcccgatctctctcttcaatccctagtccctgtgatttcagcaggaaaatatctagaattgtgttcaaaccacagggtcaggcagagtgaacttgtttttgaaacaaaaacctgaagctctgctctttgggctctgagtgaatgtggctctgcagtggccggcagcccggtgtgctacctctgcgagagattggcagtcccagttcacccccattggggtctaggatgaaccagtcaccagctaagtttctggcctcactgcttcctcacgccctaccctgcctcatgtccacttcctctctgaagacaggactcagttgttctctgtcttctttgcttgtgagttggtcctagctccccactctttttcaggccagtagctgcctggggtgtaagggctagactagggtggtgtgtcctggagctagaaggggggttagaactggaccacacctaattgtcggcagtaatgggaggagcttgaggcagaggatttaagaggcagactcttgggaagaggctgaaaagcagagtgtctggccaagaagacaatccctgagccaaaaaaaaaaaaaaaggagctgcaaggactttgtagagtaagcaaggagccttgggcctggatggaagatgtgggcctatattgtgtgcccggtgcattgtaggtgctttgttgaataaataaatgaaggaaggaatgaaccaggtgtagacatgtaatttaaggttctcccacacccaagtcaggtagctttcctgttcagaagtttttggttaccctctcactccccacacatctgttctgtgccaggcctggactaggtatgtagggtggcgaggcaaagagagaggggagtgggactcagtcctgccgctgaggttcccacaattgatgtggggaagatgggcatggccacacacagctgcaatgcgctgtttcctgacttttgtgagtctcaactcctgcagacctgctacctctttctacagccaacttactagcacttcctttactaccctaaaatgaaactcctagaaaatataacccatgcacacacataatttcaccctgaagacactgcttgaggtctctgcaaattgaactaggttaaactttggacatcagtatcaatcacatgctaaatgttattaatgatattattaatattaatatatattgcttattgagaatgtcctgtgttgccaggtactttctacatattgttttaatctttgtactaactccatgaggtagacaatgttaccatccccattttacacacaaggaaagagaggtaatgaaaagtttccttaggaaattgcctgaagccacacagtaaatggctgagccgggattcgaccccaagcactctagcctcaaacccgtactctttccatgatactttgctccctcagaaacagcttctttagtacagacccttttcttaggggctgccatgcatcaaaataccctgagacctcctcttggccgatgtggtccctgtccctcttgagccacacatgttgattattctggcaaatatttaccctccattttacctgggttctactttcctgagcccttgtttttccccctctccaggcaactggaaattcaagttttaggtaggctatttcttagacaggagtggagattctgcaagtactaaataaactgaccaagccacgaggaaaccggctgagtcctacgtgagaacatgaaggtgtgggtttgttctgccaaagtttattggactcccctttatgtcatacactccctgtgttatattggggatacagaaataaatgaagcttggtccctgtcctgaaagctaccaggctagttgagaggacggtggggagttattttcagagggacatggccagtgctgtggtcacgggagagaagaggatggagctgaggaaacacaggtcaatgttaagcccagcagactagaacccaaggcaggattactggcacagtgggcaaagcgagtgcaaatcaggaacctaaagaagtggaagcagatgttcagggccaatatggctacagtggaggacattgtggctttttggattcttgcttgcttggggctcacttgagacaaccagatttagggcagctgactgaatccagattccacccaatttttggaattcttccccctaatcaagtggcagggaaggtcctgctcctaaacaagaacttacaaccacttcagcatgagcatcaaccagtatccttgtcaggtggcccccattcctctacattcctggatggtttgggatcccacagaactctaatgattacataagaagagtggcccgctctctccggtccatgcctccaagatgacaaagaaaagaaggaacaacagtcatgccaaaaagggccgcggccacgtgcagcctattcgctgcactaactgtgtccgatgcgtgcccacagacaaggccattaagaaattcgtcattcgaaacatagtggaggccgcagcagtcagggacatttctgaagtgagcgtcttcgatgcctatgtgcttcccaagctgtatgtgaagctacattactgtgtgagttgtgcaattcacagcaaagtagtcaggaatcgatctcgtgaagcctgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaagaagagtggcccaaggtaattttctaactgatgtggcactggctgcatagcatgctagaagcccccacgtggagctatctggccatcagggtccaagctgacactgggaagaggagctggagacaactaagacccagcagccttcccagcatctagcacacataacagcccaagtcagggcatgagaagcagtctgaatacaatgtcaagagtcacaggggtgtgggaaacactcaaggcaggtctgctacagatgactgtacttggggagtgcaggggagcagggtgaaatagcagtcctgggcatacaatgggagggattagcagagtcccagcaatgagggaaggaggggctggcaggagccagacagaccagcgtggctccccagctgccagctgaggctcaggactaggtgccaggtcccttgtggtggggttgctggagagaccaaggatgttggcccgacacacagtggccagtcaggaaaaccagcccctcgtggcaggggtggaggggtggtgggaggtgggaggcccccgtggcctctggggctcagcttgcttccaggctcagaggcatcacccagggcagcatacactatttgcagtccccctcttataccactttctgaggagggaaccccccagtccccggtcagactggattcactctgattccagagcagggccagttgagcaggaagaagggctttgaccttccctgcttacggagacaggccttggccaggcagagactgacatataaatagctttttattcactcagagctttaagatgaccatgtgtgccttttcgtattgtgtacagaccgcatacctatggcccgcacaatttgcatttgtgcagggatatggcaacagtaaaagtctgccaaactgctttcatttttctgatatgactgagaacttcccagtgccaagggcccaaatgggaactcccccagttttcttaagctcccttcatagacaggtataaacacctaaacagagctgcagacaacccccactccctcaccctcattcagggagacagtatcatgttcatggccaatgaaaatcaagactgtctcatggaaacagaggggctcacccgcattggtcctgggatgttgctaagcactttcattggtctgtttccccgaattccctaggtcctgcatttctaaccttttaaggtttggagtttctttgctcctaggccggcccacaacctcgtctgataggtaaaggacagaatctcttagacaacaccaggcaacctgtcttcccagaaaagtactaaatggcactagactctaaaattcatccctaaaattctaagagccataaggcagctccatatactgagtagaggcattgaccaggccaagggctgcaagtggcagacagcttgtgcttcccagttcctgcatctttaaaacaaagagaaaaatactccttgtacctcctgagggctgatatgagagcaaactaactaatcagagtgatcacgatgcactttgccaatataaaagtgagccggcagtgctcattatcgctaaggaatctagcccatttcctcctcttcctgtggttactaatgcagaaggcttattaaagttgagagtctggtggtgctgataaatgggccatgccatctggattctggctcccaagtcctagactgaggattatgctctcttccctggggacatttcaaggacggacactgcagagaaaggtttcagggatcacctttgccatgtgtttctggttctcggtgtctttacattgctggcaaagcaccttttgctggcccagagcaagattcagatggagcagataaatgagttgccgctgtgctgcactgggctggtttctcttgtaagtcttttttcatttaagcccccaaacaacattattaatttggtattgttattagtaacaacagagttgtgcagatggaaagactgagattcagagaggttaagtgacatctccaaagtcacaaagctaataagtggcagagccggaattaaaacttaggtttgtttaactcaaaatgcactgtgatgagcacacacaatagctgtcattcaccttgaaggtggtgaagttaaaacatggttgcacccttatttcccctcccagcacccccacccctggccacaacatacacatctcacttcatcatcctcttcagccaccatcctgaaaccatacctagaagcctagtgccctcagctttccccaaagggtctccacactcatgctctccttacctgtatttgagtttttatttctcagtggttgttgtggcaaggaggcaagggaaaagggagctattacctattgtgtttcccagttttgcagactttgctcagtaaactgttccacggaggccatcgacattggaggctgacttactatgttcccattctcagggactttgtcttctcacagggagcaatggctatggcccaggaatgaagctttccaatagtggaagtttaggcaacagccactgggtgacagagaagacactctggaatctttctcttgctcccccaaatcctatctgcctatactgagactggtcctgactgtgaaatttttagctcaatagttgtctccctaaattgggttccagggagtccatatgcaaatgtttcctgatgagaaccatcaggagatttctcccaaacattgtgaggcccagagtgctgggctgggtatagagaagggtggcctcatgctatggtacagcattgtgccaaggccagctcctagggctagcagcctttgagactgcccagtcagttcagatcagtggagcaagtctaaatagggcaaagaggaggcaagatgggaagccaagagtgtcaggaggtaagggttgccaactccactaagcagagggatgtactctgagggctccaggagccagccaggcagtggccagaagccttcttggtagggcctccatcctgagacaaaccttggttccacagatagctaacccagacctgtctgtccacactggttcagtgccattaagagttcactgcccttaactgtgcctttcacactcatgatgataacaataataataataataataataataataataataataaagcaacattttgagtgcctactatatggcaggcattacactaaacatttattggattaactcactcagtcctcacaataaccccataaggtagatactattttctccccctaataaagatgaggaagctttttcctaattctcctatgcatccgaggaggcatggagagattaagtgaggttcccacacttgggttcaaggaaaaggtggttattaggaaggaatgggagccagagtgcgtgtgggtaggggtagcctttagaaaagttgaaggacatgttgtcacgaaggggaagatgcagataactttattgtttggggaaaagtgacagagctcctgtccaatggccaccactttctcggaattcaagaggctgcattctcctgcttgagaaaaggtgacataatgccactggggtcctgaggagagtgctgatgctctatccccactgtttgcatgtgtcccagcccagcagactcaaaaactctctctgggatgctggagttggggttagagggcatttctcctccatggtgacaggagaaatgttgtcaatatttcctgtaggcaacaccagggcggggcagcagcttgtttctggcttcaggcttcttggactttactcgacctgtttcaggaaggtagaaaagcgtgtgcctccctgtctgaagcagtcgaaatgttcctgattagaacacagagtctttgcacacagaataatattcaaggccaggcacagtggctcatgcttgtaatgtcagctactcaggaggctgagacaggaggatttctagaggccaggagttcaaagttatagtgagttatgcttgcccctgtctgtaaaaatgaggaagaaggaggagaagaaggaggagaagaagaagaagaagaagaagaagaggaagaggaagaggaagaggaagaggaagaagaagaagaagaggagcaggaggaggaggaggaggggaggaggaggaggaggattcaaaattcacctgagaacttgttgctgtctgttggcttcttgccagggaaggccctgctgtgatccagggcaaagtggactggcaggggctatgaagcagggatggcagccagagtgataacagagtgctcccagcaggtggcgaggggctgcagaatgatgagagactagaaagaacctggtggcccagaatgcggatctgggggccagggcctcggtgtgtggttctgcaggttgtgccctgcgcaagctcacccaagtgagtggggacaatccaatagtcaagacctttatcctggggccactttttcctaattctctcaaaggcattgcagctctccaagctgtacatctagcaggaggaggcaccttatgaattcccagtgcccggagtgggtgagactccccccaattcccttctttattctctctggtgtccattttgcttccccaaaccccctcatacctgttcctactcatgagattttcatgttttaggggcatgtcttgcctaagcctcctgactctttattcttcctggagcctcactcctctataactccatcacccttttactgccagtgtctcaatccaggcccccggttcttacctcaggcaatgatagaaattatctagaaaacattgtgagtgcctgctttggcacacctgaaatctggtcacttaagcaatcaagatgaggaagagctgggaacgctcaaggctcctcccatccacctcgtgtcactcactgttccctttcacttacacatgtttactgagcatctagtatgtatcaaacactgttcaaggctttggtgacacaacaattcacaaaacaagcataaataaatcctctagctataactagcttctagttgtagttatagttctggttttggtaggttatgttcccttcgatttcaccattcttctctcttggtctgatgccctgaaaaccctcctcctctctctccctccagaaggcctcgtggtacttagacaccctgcagggatgaactgtttctcacatggggaacatatgtgtaaattttgctctccaagtgcctttgcatccgggtctggcaagagttccaaatcattgttctccaccttggatccactttcgtgtactatttattgtttttttgactgacagccagcaaaggcgggtaggggcaagggtggcaatgagcccaggctctgaaacatagcatttattaggagctgtggggtcatttttcctgttatttttcttgattgtggctgtgttgtccttcagtaagtgtctgtaggcttctatttgctagatgaggtagtggccggctctgtctctttcattcctccccttttttccttttttcttttttgcttaaaaaacactaaggaaaaatgtcagaagataatgtagcaaatgcctatgataaacatgcatatgaaccacccaaaatgaacaaatgttaacatttgcgtcatgtttgccagcaactttttctagcaaaagaaaacattacagtccaggcctggtggctcatgcctataatcccagcactttgggagcctgaggtgagtggatcacttgaggtgaggagtttgaaaccagcctggccaatatagcgaaaccctgtctctactaaaatacaaaagttaggtgtggtgtcacacgcctgtaatcccagctactcaggaggctgaggcaggagaattgcttgaacccgggaggcagagattgcagtgagctgaggttgcgtcactgtactccagcctgggtgacagagcaagactccatctatcaaaaaaaaaaaaacaaaacaaaaaccaaaccaaaccaaaaccacgttacagatgccaccgacgtccctgcattctcctcctcagtcctattttttattgtctgggctgtgatgcaaatccaggctatgtttatgcatccataaatggtatgtactatttggttttgcacttttaaaatttgtcataagtgctattatactacatgaagtaactctaaaatgtgctttcttcactcagtgttatgttttttggtatctgtcccttttacacccatagatgtagtttgttcatgttaactgctatatagtattccatcagatgaataataaaattgatttcttaatccactactgatagacacttagattatttctattttttaccattaccaactatgttacaatgaacattcttgtagatatttccccatgcatgtacagaaattttcagttgtatgtacctagaaagaagtcaaattgctgagttgaggggtatctgtagatattgcaaaatcgctctttcagatggctataccgatgcacagttctgccagaaatatctgagagaatctgtttctctacagccccatcaacatttcaccctaggccctcccactctgttctcacagtgaccgagtttcctagacactgtcataccaggtgatcatctcctatccagccctccttcctcttgcttctcctacctcactgccagatcaaccctatttaaggtttccttctccacaacatgttcccgatctactcctctggctggaatttaaggccctccacagatggatccaggcaacctttccaacatcatctcctgctgcctgccctcagcacacactcaggaagtctttggttcctccagattcttccacttgcgggtctctctccaacatgtccccacctgttgcctgcacacctctggtcctgccaccattctctacacctagtctcagtgttcacttccacctaggaaaacctcattcatttctcacaacttgcctcaatgacagctttcttggaagcctctccagataactccaggcagagtccccctctcagctcccactgtactttatatagcatttatttctctattatagtatttatcccagcagcttatacaaatcagacataaagcctcttgactcttttgcttggaaagtaagtgtaaccaaaatggatctcgttttcctttgttgcttagaattccttcaacaaactaaacaaatgtgtattacatacctactctgcactaggtgctgagtggtggctgagccagatgaggctcctggctttgtggcacttccaatgtgatggggtgaagggtgacatgcgtggttatcatcctctgagaaagttgccctcctcagtcctccgaggcacacctgtctgactggatgctcaattcctagtttctgtccccagtgcctggcaccaactaggggcctcagggcgagcttgcttgcatggcaggtcgggcattaaaagtcttggacagttgaaggaggagaaccatatttcagataagtcacagaggtgccaagaggccaggagcctgtgaccttcaggccaaccgccctgggagttgcctgggaggccacatgatttctggaacaaggcaaagggtctcaactgaaagagatgggcttggggatgagggaggagatggagtaaggacctggctacattgcagtcctccccattccttcctcttccagtccagcttcccccatgtccctctcattcctccaggagcacacgacactctcgcctggtctatccaacttaggctgaccaccctggtggtttttaaatgagtcatcttcctgtgtttgggaagggaagaccccctccaggttgcaaatgaaaagggtaggtgggggcctctcctgagccatccctctctccacccctttcttcaccctctgctccccccagcccctctgtagacattctctggccaagctgctaacagaaaaggaggattttctgtgttactaatatgttaacggtgcagctgtgactcagccctcatgccctctgtagaaggaggcttgatttccatttgcaaaaggcaatagggatctgatgagagtctttcctgtgtggaaacatttcctgctcttgcccagtcggattggcaccttatttaaacagccataacaatacatcctaaattgggtaagggaaatggaaaacaatgttgagaagaacataatgaccagaattgaatgtgagccttgcctcgttaggatttgagtgcagcaaaccaggaattaggagccttctctctggtctaatcagctgcttcaccccgcgcaccccaggcttctcagccatttcttctgagaagttagggggcccatcctctcactggattcttgcgacagtcgcctgaccagtttgcctgtctccattctctccacctccaatcttctccattctggggacaggacgctccataactccttatgacctctggcacagtttcctagaactgtgtaaactccaccacactaattgaaatgccttcaagaggtacagatgaacttttctttttacttgaatgcttgcatatttatttttctatatatgagagaaaagtataaccagcatacctgtgaaatccatgatttcacagagatattattgctgagaatgaggctgaagttcagaatcgtagactggcagaacagaaaagggcccgagggatcatctcgccatgcacatgtctttgccttcagttccaatttttgtatgctgtctgactacatctctgcgtgctgacctcctacccaaccttcaaagcccatctcaaaagctgcttctttcataagttacatgttgtctctcccaatagactgggaactgtttgtaatacgctcctcattttggggtccactcctccacccccatctcattcccagcacataattggcctcaagcaatgtttgtggaagaaattaatactcctaccatctacagcaacacagaataagtctgcttctccttcccagaacctgagcttgggatagacactcacagcgagctccttggtggggtctcaaagagagtgggtgagttccttgaaggctgcttggaaccaaggactccacctaaggacttggccatcatgaagagaacctcacaactcttcaacaaggcctcactgaacacctgcttactctgggccagctctgctgtaggtgccagggatactccatagccctctcttccaaggagatgctgcaacgctttctctgccatactcctctgtctacactgtgtgggtgggaagtagagccttcctgcttgcatatgtcaatgacaggttccagtactattttgacaggttgttccaaaatgattgctttttgattggtgcagtaagctttaggaaaccccccaatctccactcccatctctccagtgcaataagcagaacattttcaaactcttccctgggccactttagctgttgtctgagctgatccgcattctgtcgttcttaatagcttccctttcagagaatgacatgctcttctggactctttctctctcttctgaaatagagttggttttttcttgattagaaaagtaaaatatgtgtgtctgtttacttattggtaaagagtttgttacttaaagctctttatatagtaaagatattaacccttttctgtcctatgctgcaaatatctttttctttcccaatttgctattttctctttgatttttggtttgttgtgctttgggatgtgctaacatttttttaaatgatgctgccaaatatgttgacattttcctttgtgattttaatgcttagaaagtcttgcctcctcccagaccaaataaatactcatctatattctccccaagtggcgaggatgacattcatcgacctcaccccatttgagttcttttgggatccccttttctagcctccatgatgcccctccccctgcagttagcacaatttttcttcagttgaggcacaaagcagtcattaggctggagctttaaatatgctaatgagatcaccctttcccccgtcactctttcagcccctttgtaaaaggacagcttggggtggatccctttgcctgttgtcccgtctcccgcttcctaacccccttctttagcaagcggggagagaaagagaaaaaggaaagtgctaactaacttcaagtattggaggctacctagatgtcactccatttccagtgtacacttttcacctctcctcagcaactacattttcagttaggtccgaatccagagctcccagttaatggaaagtccctgcgcatctaaacactcagacttgagcaaagtcacgcagccaacagcccgagttccccagcaaccgccaggccgggcttgctgcatcttctccatcactggcacggttgccatgggaacgcgagcgctaaattactttgcgtgtttggaagctgaagacctcagctttgacgcatgtagcccagaaatcgattgacctccaattaggtttttgttgttttcttgaggcatctttctgtttgtgtcttgcctatgcctcttgaggactgtgttggagggagatctgagcatttagcttaatttttgtaaaaaattatttccaccttgacttattccaaaaagggtttaaggtggcttataagatacatcctatacttggagagaacctaaattagatgtaagggaggaagatgaggcagagagaaaacaagggtaacttgtgaagaagtcgtgatagaaagtgaatttcaggaagtcccctcttgataaatgtgggtcccaaatttgactttaacctttcatggcagataacaaaaagggaggtatgatcagttataagattcatagataaaagcaaatcaactgcttaacagaaacgcaaatgttccgaaccttgagactaaaaatctacttctttactggagattctaaaaaagatgtcacctttttagtcctatcacctagcatattacttgaacagatgaaagcatattctaaccttggtaggtggtttcttttatcaaaactttccacttttgttattgttgttgttaaataagtaaattgctttttttgtaatggcaaaatagaaaaaaatcgtgtaaataaccatggaatactatgcagcctttaaaattttttacggaattattaccacctagatttggccaccattaaccctttttttaaaagcggacattttcccatgtaaatcagtacctcctttctgcaggacagttgggcaatatgtttcaaaaggcctaaaaatgtatacatcctttgatgtggcaattctactcttagaaatgcatactaagggaataatcaaacgagtgctagagatgcatgtacaaagatgtgcatcaaaacattggttatgatgtaaagagaaagggagaaaattctgtgttccctacagtaggtgactggttatgtaaactatggagcatccatatagtggggcattatgcagctgttgaaaacaaagatggaagtgtctatttaccaacaggcctcctagactatatcaagcctcaccaatatactctctcagcaccctgtaccctttattcattgcagttgttattgcttcataatatatgtatttgtgtgcttatttaacgtctgcgcacacacacacacacacacacacacacgctcacacacagactggcatgtccatgaggatggaaactaagcctgttttactccttattggtatcccaagtaccttggtatgtaatagataataaatattatatttgttgaccaatggactggctgaagaaatgaatgaaaaatcaaggccaccaggcattcaattcttcaatttccctcccatccatcccagacttccctcaatctccagctgagccatcagtgctgcctacaaatacttttacttttgtctggtctctatggcagctgctttacgccttccctggctcttgaggccggactacctaccatctcctacttttagacgatgatatcatctcttacttcccagagaaattgggagccagcaagtatggagtccttcagtgcccttccctaccagggcctgattctgtgaacttcagacaccaggaggccattgggaacccaggctggagcacgttgggtagattgctagaaggcaaagccagacatccctgcccacttctctctgtgaacctctctctctagcaatcccctttctttctgccatcaagcctcttgaaaaggtactttattttctgcctcccattcattctgtccttgtttgcattcaagggcacagttaagtatactgttgtgcacaccattatctatccatgcaaggtccttaaatttttttatcttatttttcctttcatctctaatctccactcccagttcctctttaatggtttgatacatgctgttggaaatgtctttgaaaattacatagtgttttctgtgtttatgtgcttttaatttacataaatagtattgatccatagatcatattctgtttcttttttccctcaaccctctgttttgaggcctttcggtgctgctatgtgcacatctcgttgatcacttctgtctgacttggcactcatccaccacattttacttctcccttcctctgagactgtacatcttggttctgccaactgtccatgaccacaaataatgctgcaatgaaccttcctcgacttgctcctagggacctgggcaagaatttctctaaaccagagattttcagagtacaattcacagacccctcagagtttctgagactcttttggaggatgctcaaggtcagagctgtttctacgataacactaggacactatttgcctttttcatgaggttgatttttgcaccatttgcaaaactgttgccaccttagtgtgaatcaaggcagtggcaccagcctgtactagcagtcattgtattttgtatttttcaccactacatactcagaaaaaggggggaaaagccaccaatcttactgaaaagtagcttagataaagcagtaagaaatggcaatttttattaaatctcaagcctggagttgatgtctttttaatatcctgtgtgatgaaacaggaagaacacagaaagcacttctgctgcatgctgagtgagatggttgtctagagaagagcactgtgcaattgtttgaggtgtgagctcaacaggcctcctttttcctggaacgtcattttcacttgaaagaacaattgacaggtaaactatggttagtcagacttgagtatttggtggacatttttctcaaagatgaacaaaatgagcctgttgcttcaaggaaaacagctcacagtatttgttaccaaagataaaacttgaactttcaagtgaaaaacagaattttagaaaacttgtttctggcaccaggggcttgacagcttcccagttctttttttttaaattgttattaattttttttgagatggagtctcactctgtcaccaggctggagtgcagtgatgcaatctcggctcactgcaacctccgccttcccgattcaagcgattctcctgcctcagcgtcccgagtagctgggattacaggcacgcgccaccacgcccagctaatttttgtatttttcatagagacggggtttccccttgttggccaggatggtctcgatctattgacctcatgatccacccatctcggcatcccaaagtgctgggattataggcgtgagccaccgtgcccggccagcttcccagttcttaaaggctttctctgcctgccccttaactctttatgatctgttaggattctccagttccttgtccagaaaatcctcattgtaaaggacaccaggattgctacctgacctggcttgctaaggccctatgcatgagagtggacactgtctttgtccatcacattgcaggagtgatttggtctgcatgtcagggagctgcacaaatgttggactactgcacaggaaggctgccattgcagagcaaggcagagacacagagttgtgacacagagtttcaacatcagtgctccctgttcttcccattctccccactcagactggaccatctcacctgctttttggcttcatatacttccaagaccttgtgactgctccatttgtatttatttccagctctgagctctggatcacatatctttaccaccctctagacacacaaactgtgtcccaggcaagctctctcctcctcatccctgcacctgctggttttccagggttctctaacttaaggaatggcaccacccattctatctccatatcaccaccatggtctattctccctgtctggccccaccgctccaccctgaggcaagccttcatcatgtctcatctgggccccttccagagcctcctaactggtgtcccggcccctctccaatcagccttccacattgcagccaccctactgatcttcaggtcactcccttgcccaaagcttctgtggctcactatcaccttcaagataaaatccacacccattctcatgacatttaaggcctccctggtctagttccaactacctcatcttctacctggctataccagatcacttatttttcttcccaaatacgagaaaccctcatacctttatgctgttgctcaaaacgtcctctttgcctagaatgtcctctctccaaacctcattttactggcaaatgttgcttcattcttttcgagttcgacatcaccttttcttgatgcccttcccttcctctgagggaaggaattcagttctgggtgctgacaactggcaatgaatggatggctggggagtgaaaggggattgcatcaaatgatggctggggtggttgaggttgcagaatttgagctgatccctaaaaggaataatcttaatgataactaacatttactgagcacttgctatgcaccagaccttgctctatgcactttctatgcattctctttcagtctcattctctagcaaccccaaactcactgtatcctcactttagagatgaaaaaactgagggccagggttctatcagcggttatgaagctttactgaggggcggcttggtgatctgcagcagaacactttcttaccataaatagcagagtagggatagcatctagaatcacttgcaattatgtctgtctttcacacaaaggggaaaaaagtgcatttgacctcagaagcatgaggccatgtggtgaagcacaaagactagtctttgaagtccatctagctgtgtgaccttgagccaatttcctgatctctctgagcttcagtttcctaaagtgcgaattgaggatagtaatagctccattgcaggtttgtggtgcagatgagctatgaggaatgccaaagaatccagcatggtgttaggtacatagaggggctctgtcaacatcaattcatttttctccctccccagtgtctaaggaaagaagtgtagtatggtgaaactcacactacctcagaagtcaaaggagttgtggtttgactctggcactagtaaggctgtgcaaccctcagcaagttacttgccctctctgggctttggtttcttcctatacttgtaacataaagaagttttgttttacagcagttgggtgtttccattttctgtcattgaattgggaaaatgatcaggtcatgccaacctgggatgctgcgtgttgtggaagttaggcatatctgacaacgggaaatacttcctgaagacacagccttcggacccctggttacctagaagggagctcaggactcctcatcgacaaacataaaaccagctccctgcccactgcccaacctccaggagatgcccccacaggcttgtgtgagcccaaggcaggcctcaagctgattcaagggcccagctgcccgttgccatggcaacattccagctcgctttgcatagtgacagggatgctaggctttgctaacaaagtgctctgtaaaggacttcatgtctttggcagggacaattccgccttctttttcacatgaataactctgggggctgtgaggagggatttggcaagtcacttcccctgtcttggcctgcgcccttgggttttccttgaaggcacaagttggcagctttttatttttctatttccaaatataccatcactaccctcctcctgaccactccccactccaaaggaaagaatggtttttcccttacttagagctctggtgaactcggtgtgtttatgaaaatggaaggaatggactgttcgaatcactcacatacccttggctgattgctggatcaaattgtcctcaatccctttttcttttttcggaatgcccaatgtttttcaggattgaaacaggaagaccctatattgtcctggtgaattactccctggagcaggaaacatatttggaatcctgagtaggctgggaaggaagccaggcagacctgggtgaatcctgctttcatcacttacaagctgtgtgatctttggcaagttacttaacttcccctaatctcagttttctcatacgtgcaatggggatggtaatacagccttcatgggtatgatggtgaaattgttatgaggtttaaatatatcttatgcttgcctgcttctctctgtttccgtcaccctgatcctggcccatcatcttttgcctggactactacgatagcctcctgcccatttctactggaacttccctccagccctttgtttacatagcagacatggtggtcttttaaacatttaaatcatatcctgtcgctcccttgcttaaaatgctctaatggtttcccattgcacttcagataacatccacctcttaccccctacctcttccaccctagacatgctggcttcctttccatttctcaaagacatcgaggtccctctcacttcgtggcctcatggccttggcactttctgttccctctgccagctccttctcaggctcagttcttagctcggagagaacttctcttaccactcatccaaactagctccccatgcctgccccatcccttgccatcacacatcaccatgctgatttccttcatggcacttctcaggaactagtcctaccttgattattcgtgtacttggttattgtctgtctcctctgcctggattgtaaactctttacatctgcctcattaacctctatcacccactgcccagcacagggcctaatataataggctcaataaaatctattgaatgaatgaatgaggtaggtagagcattgagaacaaagcctgaaagataatagagtgcaatacatgtttgttactttctttttgtcttcttccatcatctggttgtaaggcagagggtggtgtgctagacctgtggcctccaaagtggatatatcgtctattagggtgcaaggagaaaatattagaatttctattaacagtcatctttatcatatcctaatttccatgtttgtttatgttttaaattttataaaactgattagcacagtagtacatatatatggtttatacataaatatgtatatatgggagtataggctcaaaaatacttggagaccacagctggtgggaagcaaactggcagactgttggcagaatgtgaactacagataggttgggttgagtcagcagagaggtttcccagattggaggttgagtgccttgggaacagggttgggggtggccagcatgcatgctccaggtctccaccacaccctgtggcttaccctagcctacttcattcatggccctgtccttcctgaccattacaggcgtgtgcatttccaaccctagagagggtttcctttgcaagtctagagaaccttctattctggaaattggtgctggtcgatcccaagggggaggtatgtgggaaagactgaggcctaggagccccctgtgggcagcagctggggcttctcattcttgtgtcctctgtaaccagaatagtacctggaacagagtgggtgcttggatcatcagagaacctgcttgttgactaatatcagtgcataggacaaccccctctgagtgtctgagctgagaggaccctcaggaggtaattaggttcatatgtttcactgtccggatggaaactaaatggggctcaaaatggccagggcctgcccaaggtcatagagcctcccgccagcactctttcccttgtgtctgcgtctctgcttagcctctggggtgtatgcttattcacgatccaggccttggctggttccacccccttggccttggcctactactcttaacaccagctctcagaaggcgttctggcttcttactgggataggggccaaaaaagaaaaacatttcccaaatcataattctacagcctcctgcctcccccaaactcactttctatgtaactaatccccgtgttccttggccattaatgacatcactgcctttctggtcactttggcccaaaatacaaagtgttctacctcccttgagtaggggctactatgtgtcaggcactttctaaaaaataaactttgtatgggcaattaacatacaaaaaagccacacacgttgatgaatgatcacaaattatacacacccatgtacacacttccaaggccaagaagttgaccatgcccaggactacagaagtaacccctcaaagcagtttttaaccatcactgcagatcttttgtccagcagccttgaggaaggtatgagtaattcaatccaattcacagataccaaattatttttctttaaaccaactcattccattctgcctcgaatagtcaagaaattacttttcatgcactcaattttcccctgtaatttttattagaatctagtatacattagaataaatatgtgactgttaaactttaaaagatcatccatgtatttctaaaattcctcatcatactatcacctcacataccactagcacaatgtgtactgcatttgggggaatactgtaccgtgggaattaactcaaggggaagactatttacgtttgggaagatcagaaaaggctcaagatggacctgagatctgtagagaggatatggctatgcagaggtgaagtcgattctggctgtcaggctcagagaaagcttcatgggggaggagacatttgggctgggtcttgagaaataagtctgacttttcacaagcagagatggaagtggaaggaaaagcattctaggcagaaggaatagaacctagagaacacttcatcagggctagaagagaagtttatgtttcaggcttgagggactgtgcctgatgtgcagttggaaagtgtctccgggcccagggttgagtgagtttgctctcttggggcacacaacacacaagcactatgaggggtagccgctggcaggctacagcccactggagtcagagtcagagtgtgtattagaattcacttttccttatggaacttgcacctggaaattccccacaccagattagagcatgtgcaggttatggcagatgggatcagcagaatgaaaaggagacaggcttggagtcagcctaacttgggttcaagtcccaaccctgccacttactagctccatttttttatctaatgtctgtctccgcatcttcagcttaggtcctaataatccacacctgacagggtggttgtgaggagtaagagcatgactaaagtgacaggggtagttcttgtcccagctcttgggttccggggggcagtccagagatagtaccacctgccgcacttccctgtccacccactttgacatccctgagtacagaggggtacagccagtgaggtggtaatgatgaaccttaagctgtttcactttggggacatgggcccctgagttgcttctttcgggcctcagacttctctgtctcctcccctggtgtgcctaaggcaccaagtagggtgggggaccagccaaatggtgaggcctggccctccctctctctttgatagaactgggtgctcctggctgggcttagcttgaaacacaggcgaaaaagaaagaagccattcttccccaaactccaagtgaagacaccacagggagttcagcccccctcctaaagccaccatgcctccctccctgagcacagtgctcagtgaaaaggctagccagcctttccagaccctctccataggcagtgatcttacagcagtgaacccatcagaacagcgcctccagcaccctacccaacctggatgtgcaccttgatgagtagaaagggatgagaaaaatttgagaagactcttgggttggtgggggaacaaggaccaagcatgtggagctttcagagggatcatcaaggagcaaaggagggctgggaggaaggagaggaaggaaggtctgcatgagcagggtagcttggcctgtgcccatgaatgggcagacactaactgagtcatcctctgtgcaaggccctccacaaggcacagcttcaaacacccaaactttggcccatcccgcaaagaattcataagttgctggggcagagaaggttcatgaatacgtggaagatttggaacaattccaggacatctatgtttaaggacaaatgagaggctcagccagccagaactgaaggtattgagaggaattatccctgcagactgctagtagggatgtgtgtaaagagggctttcaaggggtgatgggatttgggctgaagcttaaggagcagcctgtagggtttgggaacagcaggtagaggcggtgagaggggatgggaagcactgtttagcaagcacctactatgggcctggtgtcgtttagctcatttcagcattatctcatgaaagtcttacagcagcttacaagttaggtgttttcattcccccattatacatggaaaatggaagctggggaggttaagtaagttgtacaaggttacacaggtagaaatggcagcatgaggatttgaatctaggcttctctgaccacaaagcttttccctggtggctttaccatgaaatgataagccacaatgacaagataaagaagagaatgagtagcccagattgaatgggcagaggggtctgtttcagggaatcaagagagaggaagcaaagaggtcagatgaagccggttctgagtataggctggagagtgtggacttgacactttagacaacaaatcattggaaggttccaagcaatggagtgatgtggtttgatttatgtttgtaaaagctcactctggctgctgtgtcatgaacagattttaggatgcagaggtggaatcagggagcccactgaagaagatattcattgaaggggtctggggaaggatgatggtgactgggaccagggtgagggaagtggagatgatgccgtgaagtgctccaatttgagacagttctaaggagcaatttacaggactcagtgaatgcgtaggggagggagaggaaagcataaagatgtctaaaagcattcctcatccaatttagattattaaaaaaggatatggtggagaaagcactgaatgtggagatagacgggggtccaaaacctggctgcaccatgtactagttgggttcatttagtccagagggagtatgtgactcccagcagatccttaagcatctaatgggctatggccatggggacactggtgcttgggtgagaaaagctccaggggccacaatggggcttacagagaggaggaggtgaggacatgggacacgagatataggcttcccaaataagaagctcagatgagaagaggagaagagtggtgaggcagaaaggacaagggagaaaggaggggttccgcgtctgctcttctcttttgttgttcttcctccaatgggaacatcttgagcatgggtgtaggcccagtggaagaagccagtatggaccttggctaagctgcctcccctgtcttagcctgtttaagtatctgtggagtagattaaactagtattatctacctgacagggctggtgtgagaacaatatgcaatgatggttaaaaaaactgctttgaggctggatgtgatagctcacaggtgtaatcccagtactttgggaagccgaagtgggaggatcacttaagcccaggagttcaagaccagcctgggcaacatagtgagaccccatctctacaaaaaataaataaataaataaggaaaattagctgggagtgctggggtgctcctgtagtcccagctactcaggaggctgagttgggaggatcacttgagcccaggaggttgaggcttcagtgagccatgatcatgccactgcactccagcctgggtgacagagcaagaccctgtctcaaaaaaacagacaaacaaacaaaccgcttcaagaagggcttctgtagccctggtcatgttcaacttcttgacctaagtaggggtacacaagtgtgtccaggttgtgatcattcactcattcctcctccccaccacccccatgcctttactccccaaactcttccaaaacatacctgttcctattcaagcttcctcatgttcctggaaatataatccagggtcccaagtgcacaacccaagcaaattcaattctattttcactttcaggatgtcccatgcattctagaatcatctcaagttgtcatggtcctgtcttttctagcctctctgagcttaaagtccatgtttacaaccttgaagctaccaagactcatacctaggacccatcacaaatggataagaggtcaggaaccaaacattctccaagcttcagttattcacttatcaccttgaagatttttgctgtgttcaatcttcatgatttttatcatattcataaatgtattttcccaagatgcttcacttctggcccttcatgcttgctctgggacctctatttcccaagccctcttttctggcctcagatcgatccccttggaagcctcacattccacagtgagctgcaaagcccaagcatgggtcacactatcctgtgattcctctctataattatctgttgcccccactaggctgagacagcctgaagtcagtagcttgagagatgtttgtggaattgttgaagaaaactgaagagacccttgaaagctggagactcaacaggagaggttcctagcaggggtaatattccaaacagttaacagtgtgtccttcccctttctgtttctggccaactgttcttcatctttcatgacccagtccaagcatcacctcccctgggaaggtatctctagaccttccagactgaagaagcttctctttgatagtctcacaacattattgatccttctctgtattgtcatggcctttggacatgtcattcacaccctcctaggcaatgactggcacctctatctccccaacgctcacacagagcctggccagagcagatccctgggaactgctgaaagaatgactgaatgactgggcaggtgagtgggcagatggatgtggtgatcccactttagatctcttgccccaaagtcagaaagctctgctttctggatggcacagtgccccaagtcttccaggctgaagctctagccagacccacacccacagtgctttgtggccatgactattacagacaggccccctgtcccagtgagcagaaatctgatgacatcagcattgagcagtaccaccactcgcctgagtgaaggcacttgaggctgtctagctctggcagagttggttccaggagccacagcccttcctcacagccaggctgctggggctggaatgggctgctgagctagcaccacctgcccggtgtcgcttatcccagagggctgcagcactcacagtgagcggctgcgtaagtgtgtccgtgtgtgtgtgcgtgtgtgtgtgtgtgagagagagagagagagagagagagcgcatgtatttgctgtgggactcatggaaggagccctctcattggctgccaagggtcccagttccagtctgtgaatctctgggctgccagctctgccctcccctgggaaggcaaagcaggagagggaggggagagtggagtgaggcttcaggtgtgtctgacaaggaagcaggtacacctggtggccacactgggcattcttgtggcatctggctgtgctagctccaagtctgcagcctgacagctttgtgctctgcccaaattttcccagatttctgttgggactggagcccagagctcattggcagctgtcacttacagaactggatccatcccccagtggagcagggagctgtgtcacttagaattcctgggtagcacattccttcagtagaccctgtcacactcctggattaggctctgttattggccccgcgctcctgcaagcttctgcagacagagtgagcgagtgagcgagtgagtgagccagcgagcggcagcaggaatgacagcactgagagcagagacagccagggacggtgagggcgggcgagtcgggtcccggggggtgcctgtgctggccctttctgcagaggcagatgaagtgggggccactttcagggcttgctagggtttctcttggaacctgggctgctcgacccgagtggagcactgagcaagggggagggggaaagggagggggagagagagggaggaagagagagagagagagactgagagagactgagagaagctcctagcaggctctagtccaagtgagaggctcagatctgtacaattctgtgccaggggcacaagtgggatttggaagagccatgtgtgtgagaagcaaagctgaggtgatgtaagcacctggggaggagcacaggcagaggaggaggaggaggagtaggaggaggaggaggagaaagaggaggaggaggaggtggcagcggccgccgcggtggctgccagtccagagcagaatgatgggcaactctcaccacaagcaaccgaggagtaaaagccaaagcaggatgcattcagcaacaggtactcttttcccttccctccttttccggggctcctacagccagggcctcccagctgctgccatgcggggcccctgacccttggcgtgacttgcaggggctggcagggggcagggagagaacccgagggaaatgagggtgaacttccagctcccctgctcctgtgacaggctgaattgcataagtcagagcatcctgagctgggaggggccagccccttcgccggcaaccctgtgtagcctctggagggtggctggagtgtcagagaagtgagcagcgtgccagtgactgaagttcatggctaggactgtgctttctccctggatccagtaggcagaatcttggaaccatgcatggcttatcctttactagccgagcctcctttgttattcaaaccttcgtctccccccaccccagcccccatacccgccctgaacatgtacacctacacctctcctggctctacctcatatgctgcatgcatggaatgatccagacaaatctgtttcttgctgtgtaatgccctgccccccaccaccctgccccagccctgacagagctctcctcatgcatgggcgagaagagcatttgccggccttgagtttgttgttcccctacctctgggtgtgctctgctttgccccttccttgcccctctccagatatggactcaagggtgctggcatagttctccccaacaactccttcctggatgctgacactgtggaaatcaaggtctgcagacaacttttcctagctcaccttcccaggcggtgcaagaacaatttggaagcaacttctcttcatccattcacccatttccaccaactcttaccctcctatctaccccttggccacttgaaagtaccttccactgctacctggggttaggcttcatgcagtagggtcacaagtactttctctctgtgccctcctccctctgtcttggtggagttccctctcctcctttgtcagcacccaccacccccaccaccaccaccacacacacacacacccttcgcatcacacagagtccaggaggagcctgcagttccctctgtgcctgtttgggaagctctcattcaccattcgggcctgtgagaaggaaggaaaagtttttgccaagtttgactcacgtttaccataagaaagcaataaatggattgttgtcttgccaaaagtgtgccatgctccggcccagagggttgcctctgcctccttctggggactcagctggctatgcagttgagggtagttgtccaaggccagccagtcccaggggcagccctacaatgggattcttacagggcgtggtggggagagaagctacaggaaagcaacttgggatatgctggcacgcagggtaactgtttctggagcccgcctgtcagagcagggctttgtttggcctcctatatgggctgaatttgggtctctgtggtggactgagccaaagaataaaaattctgagcattgaagtttctttggaatctttcagggacatactcttccaaggccaccattaggtgaatggcccaaacaccacctcagagtctcctgcttctctgccttggagctgaaggcttaggacctgctggtattacatggagatgctctgtgcagcccagtacagaagcttgaagataactttttacataattgctgatgtgacaacttgggacagttactggctattgtgtcatttcttagaagttgctttgtatcttcaatgccagctccaatccagggtcatcctagacgtagtagctatgggaacagcctctggcagcacgaggaggtggcctcataactgcttctccctccctctcccttccacctcttggtcctcaccttaccacaacaccacaccttctcactcacaatccctaggtgatcccagaagccccgattgaacactcactcccactgggctaaacttgtgccactctttctcttcttgctcgcttttctctcttccattttcgcttagtgaccccactgtctttccagtaacccaaactagcatcctggtagtcatccttcactcctctctctctctccctcaccacacactttacagttttcactcatccatctatctgctcattcattcaaaaagtattcattttcgaggcctcctctgagacatctgagcccctctcttatcctactgtcagtgtccaaatccaggcctttggtcactctcgcttattccagaattgggctgtctgcttccacctctgaccttctcctgggcacgcccaacacagccaccagaatgagctgtccctgtgctcccttgctatgaactcaagtcttactaattggggtacgagagattacgattgctccccaagtgtggagtggatctcaggtggcccaggggatcattgtagttgtaacagagaaaactctttttgcctttcaagttctgtatatattttaatgtgtattcaaaaaatatataactaatacatcaaacccatgatttctcatatttttttaaattagggtaaggttaaatgtttttaaagcgagtctttttgaataaaatgattaagtaaatagtagaataggaagcacatggaaatggcaaaagttgggaaactgagataccaatgcctgaggcttgagaagcacccatttctaggataaagtatgttttccttagcacaacttagagatctttcatgattgggcccctcctacttctccagcctcaccagctatcatttctcaccttgaacttgatccagccatattgaatgagttgaaggtctccaaatgctcccattcagcattaccatgctttcactaatgcacttttctctgcctggaacacctcctccacctgctatcttctcctgacagttttctcttcagccttcagaatcctgatcctgtgtttcctcttctctgaaactgtccctgactgaccgccttccttcatacaaattaattaataaagttcatcaccccctcctcggtactaaattgataccttttacataattttatcattgctggtattatcatttttatacttgttattgcatgtttatctcctcctagtaaaatgtaagcttttctagggcaagggctacaatttgtataccaaagggtgggaaagaacccttgaccaagactcagaagacttgggttccggtctctcttacccagtaacctgcagggtgatcttaggcagctcatccacctctgctacctctgtcctttggctataaaaagctacaaatcctcagggggatccttagcacattcccagggtaattgggaagatgcgatgtgagatagctaggaaagcttttgaaagttgaaattgcttttcaaacgaagaagggtgattatgattgcagagggaggaaacttttcccagaggctggagccagaagtaagccccacaggtttaggagactgtggaggagcagccaggctgagctgcagcagggaaaggatgagcaaaaccagccacacagccagtaagggtgagggtgggggcgggggggagcggggcagtcgcagcacgtggaagcccaacaggaccttagagcataggttgctttaagactggaaagccttgtctgccaagctcatgagttgggattgagttctcaccaactctcacctttcgcctattgagtgagtgtagccctgtcaccctgtgaatctgtatgtggtggggagggggatgcatgctagcgccaccatcactatacagcatacgcatagctgtgcatatatggaccagctgtttgaactagcatcccatagagaagagaaagagagttaatatccatcatgcacctattatatgccagcacttttcatccacaactttacttagctcagagaaaccaccaggcagggattattgatgccattttacagataagaaaactgagacactaagggagagctgccccatgatccaataacaaggaagttgtagagccaggatttgagcccaaatctgcctaattctcaagcctgtgcctattgcaccataccatgtgcttctcagcatctttgcatctgtgacaggcattagtaaccctggagactggatgtggtggaaggaggggtctgggcttgcttgtggtagggctagcaaatctctatggcaacaagggctgcaatgcccagccttgtagaagtcccaccacatatcgtttgatggcatatttgtattattggaataactgaactcattggggactccatgctgggtccagaagctagagccagggattcctgaggtaataagaaagtagaggattcttgaatttaagcctaaaccaggttaggctgagagaggcttcagatccagacgactggtatcatgctggtttccaacatccctctccccgcaagcaaccgaatcagcactgtaaatacggtggcctgtgcttcaggatgaaaatgagtccaccattctcttctctgtacctaaacaaaatgaggaaatcatctcattacatttgcaaggcatttttatagttgacctggctctttcatcttcacaagtttattgaattctcacatcctcgatttcagtatggtggaagctaaaatggcagagacttataagggagtccattgacccctatccccctgggagcttcttcctaaagacctattttctagtcagacttaatgagtccattggaaggtatggaagaagttaaaattctaggccaccgaacaaaatatttcctggtgccctcctcccatgactgagagatgtgttggaggcagaggcacaggccctggggattggggccaatcgtgatatgcccacattttctgggccagaacatagaaggaaacaaaaagtaggtgtaaaaagaaaggtacaatggccaccctaatgtcaaatacaaggggaatggcaaaataaagatgttgcatccaacttcactgaaatatggtagaccatgaaagctaattatgaagacttgagcaacatgaacaatgcttataataaagtgtaacatgcaaaaggcaaaacacaaaactgtttctatgctgagcttcacaaaccctgcagaaagtatgtctgcacatggccaataattggaagagaactgtggaaaaatcaaaacttgatttattgtgggtggcaggcttggtggatttttctttcccttagatttccattaatgttgttataatgttgtttgtgcaaagaataataaaaaccattaacacatacaacaattacactgggaaatcattctgtcaagctgagagaccaaatcatatcatttccctgagccagcaaacacactcggaagacataaagacaaaattaggtacctttttggagagaggcagctacaaggaatggggagagatcatgaaattagtgtgggaagctgcacgtttgaactcaagttcagatccttatgttagagaaagctgtttcacccctgtatcctcagtttgttcatctgcaatgtatgaatgttgataataatagcctgaggagcaaatgatctgggacattctcaaagaccttgtgaagtgtaaaatgctgcatattgtaaaaccttatcatggcatgtgtatggatgctttgaaacaagagtgttagatactgttttccactgtcacacccagttgacaacaaagccagcctgggcctgtgctgctgggtggcttcagttagcaaccaccttgtcttctctcagtgctgggtgccattgaaatctgattaagcaagcaaagctttctagttttcgccttggatgggaaatcatcaagaaaatgttgtgggtttttctcttcctctaaaatgcttgaactctgaacatggtgaagacctccacagctcttggattctcagctagacttggccagttacaagctgtgtgtcttcaggcaagtgacctaagctcatcgagcctccttggtcagttggaattaatagtgcctacctcatggggtggttgtgaggatgaaatcaggtgctgcatgtaaagcacctgctatgtagtaagcaaggagcgtgtgtgagctgctcttgttattgctcaagatgatcagggtaagaagggtctctaaaaatcacctgaaccaggggttctcaatgaggcggtgagagggatgtggagggggtcttgggggagcacagtgtgtgtgtgtgtgtgtgtgtgtgtgttgtgtgtgtatttttttttctgagacagagtttcactcttgtcacccaggctagagtgcaatggcacgatctcagcccactgcagcctctgcctcctgggttcaagcgattctcctgccttggcctcccaagtagctgagattacaggcatatgccaccacgcccagctaattttgtatttttagtagagatggggtttctccatgttggtcaggctggtctcgaactcccgacctcaggtgatctgcctgccttggcctcccaaagtgccgggattatagatgtgagccaccgagcccagccgaacacagtgtatattatatatggtcatgcatattattatttttgcatggcaacattgaaaagtcttccacgagaaaagcagatttttttgtctccattatggtgagacccaggtattttagtaaaggtgaggtgtgtgcttagaaaccactaatctcccacaaacctttcattttatggatccacaaaagtaaggtgacattcccagggtcatgcagctacagagatcaataggggcaacagtccagtttctttccccaccactgccaccaccactgcccaagagttgttcttatgacctctgggatttcctcattaacagagtagagacaccctaggccacatggtcatggccgtacagccattatcaagctgggagaaaccagacaaggctctgacattgaaaagaggcaaaaatgatgcttgagactacaaggaaagatgtccttggtaggagaccctgcacactgatgtgtcagctcctcatcacccctaggcagtactttcaaacaatctgggctaacgtggcctcctaagtgccatctccagtcatgtggagtaaattgtctttgatgaaaccttcatttctctcaatagcagattttctatttcaaaagtcagtttcctgtcaaaatctcccagagcacagacagaggggtgtgggggtcccaggagcagggtgaggctcctaattgctccccaccattcgggtggagtgtgttctctgagttttgtttttggcattagggagggtagcacagagccacctctatcaattccttttgtggaattcataggcctggtcagggtggggtgcaggtggggtgctctttgggccctttaagcttgtctcagagatgtgcaatcccctccccgatgccacacaggagataaaagtcatgcactgcccctgtggaatattctgacccacctagcagcctggggccctgcttctgcttctgggacctggctttgggggtttctagcttcccaggctgagctcttcacactccccccacctccccactgttgaacactgccacttctggcctctcccctgccagaatcttgactatcccaaccctgcaccataaccgtcttcctggctggcttgggggatgggagctgtctgcccagggtacagagcgaggttggaaaggttgagagtcatgatgctcagagccagaggtcacactgctggttctgaggatgaagatggctccccaccgccctcaattacaggtctccaaccccagaaacatgaggtctgtgtcatggaaacttatatacacagccgtttccccacccagggacaatagcttaccatgactccagcccaaagaacgcccaaacctgagttgggggaacaaaagacaaatatggactgggactctaatttgtggagtcttcccatctcaaataacatgtggctctggccatgtgcaatgtgcaatggcagctcctaccacagcaacagaagccacctccagcccagagggatccggggtgagatgtgactgtgaaacaggatgacaaactcaggtatgtgtgaggcaggccagagacaatagccagtgggagagccaagcccagagtaggagcagcagtgttttagaaaggtggccctcctgcgccttagagggaaggcccagggtaccggtcagaaaggccataggaggactgctaggaaacacgggccagctccagcagggcttctgtggagccaggcagtagcttgagcagtgggcagatatttactcacagagtcaacatagcaactttatggcacaggtccttttattagctcctaaagggcatatataaatgagaaaccgtagactacataagtgatctatagattagaaactgaggctcagagaggttaagtgacatgcccaagggcacacaggctgtaaatggtgaggctgggatttgagcccaggcagtagggctcccaagtctgtcttcttagcccctatgctaatctgccaatgtgaggggggtaagagtcaggctgtccttgcttttagcccactagctgggctttaagactggactttcctaaaaactggtgcaatggttctccacctggggagatttgaagcagtatcaatgcctaggctccacccctcagaagttctggtttaattggtccgaagtgaagttcagccttcagagagtacagagggtagggtggaactgcagttttcacagaagctcctcaacttaaaaacacacagcatctctcccatcctgacaaacatctgactcccttctctagttctgcctctccctccagctacggccctctttcctctctaaccacagccagacttcctgagaggtgtctcccctcccctcccatttccctccttaacctgctgcagtctggcctccgtgaagccatccttgccaaggtcaccctctgagtggtgctaaagtgaacagtgcttacgcctcggactacttaacttcttgaatgcatctaaccattccttgctcctggaaactaaccctcttcccagctcagggacacaatgcattctccttgtctggggatttcacctcagtctttttatatggcttctgtaccatgctgtacaaatacattctgaaggtagggtctccagagacccatgcatgagccctggccctgccctcaaagagttgaaagtcttttcaacgcagatggctctggccatgtgcgaaggtagacctccatcttgagccttccttcaagctgtttccttgtctttctgtgtccctggcaaagatagaaaagagagtaagtctcacgctgagtctctttccaccctgtgagcaagagccaatgattcctctcttccgattagaagacagttactggaacgagggctcaatccatcgcccatgctcattttgccaatgtagtcatttagtaatgaagaacaaagaagtccctttgtaaggagcttctcccacatgcgatttgtttcctgggtccttgtccttccaaacaaagagaaacaaattggaacaagatatgttttcagtgtttgaaagccagtgattctcttgtgctttgtgcaccaggaaataggctttgctggaatctgcagtctattggcggaagtgtaggtaggtgaagaggtagggaagatcggcagggttctcctgatgccacgaagagcaagctggatgaccccaagtctcatcctttagctgttgggccttgggaaagcccctttccctttctgagcctcagtttcctcctggattaaatggaactagttgtctttagctcctctgtggtgaggatgataggagatgacctctatgtgctgtagagtaggccattgctaggcgttgggggaaattgaatggaattgcatccagccgtagttcacagactcgttccaggccaagagagaaagtgtgtgtgtggaagagagacttgcaaaaaacaaggcctatccctgtgcacgcctctcctctgggaaggaaggggcctgcacagtgacaatagaccaggggcgctgactcagacagccagttcctgttcatttcccctcactgcaggacagccgctgagcgggaggtcagccctctgaggggctctgactcgggcctttggctgagaaccttacctagagaaagacaagcccaactcacagtaaacttccctcgcctgtccgctgtgactgggccgacgggtccagggtggctgtgggtggagtgcagcggggtggagaaagagagaggaaactcacttttgaatcctcagttgctttccctaggctgggctgcccaggaacaacttcaatgggcaaaggagtatgtgatcgatgggaccaaggtgctgggaaacggggttcaggaaagtccctgggcacccactgaggagcctagggacagggtttgggacagtgtggagcccgtcggctccctgcccccagtgtgggctcagcacacacttttctcatgtggattcttggttatccacaccgctgggatggagagaactgactctgtcaccctcttctggatccggggaggtgagtcgttgggggaagaagggtgcatgctcagcagaggggaaaagggaaggaactggggctcatggaggaggaggagctttctgcactcacagctatgctgaggcagcctgggctgctttgggagggagtgggactgcgttctagaggtgtgcacagaggggcaggatggccacttaaccgagatcctctgaagggaattcataatcggatggctttggaagacagggtggatgtgatcacatcccaaccctgatattctgggatcctaaaggattaataaaagtgatggaggaattctgcacgtgtgtgtgtgtgtgtgtgtgtgtgtgtgtgtaagaattactgcacctcttacttcctctactcttgtcccagattctgaggccttgtcccttcggtggtagaaaattccatctcattcaatccatctcattcaatcttggggctttatttgcctcctggactcctgctaaaatgctgaatttatttttgcaataccaaggcatgtaggcaaggagaggcaggaaaggggttcctgtcactggtcttctgtacacacaggttgctaccaagggaccaagagctttctaattgcagttcaagccagacctcctggcagtaaggcagaagcaagtacagggccctgtgccacactaggacccctctctggcttctgtgaagaagactagccacgtggtggtgggggagggggcgcgtgatgccacagtgacatgcccttgaaaatgtctggaagctactgcttgtggaggtagctggcaggacagactgagtccatgctgtgtctctggagttttagttggccctttgcatcaggcgtatgctcaaaagcagtttatgagctaaagtggtgacgggaccaaaaccgaagtcccatgaggaccacgtgctgtttggcatggagaagaatcagaggaaagtgatctttggtcttcaggtctttgagggactgtcactggatgatgggagtagatgcggtctgcgtggggcctcaggaggcaaagctgaggtctgtagacaaggaggaactttccaacagaccctccatgggtgcagtggcctgccttgaaaaggagccaagggtcttggtaacttttgcaggttacttttttcacagagacacagagtgagccctagagaagaagggcatgtaggagcgagctttctgcttctgagggagagagaatgggaaggaggggccaccctcacctgggatgaaggcccaacacccccctgacctccaccttcacaacttctcacctggtttggcctccctcatctctctccctcctatggggctccctgcttccactctccagcccattctccactctgcagcatgagcgagcctttaaaaaacagacgcagctgctcaaaatcctgtgatggcctcccatggcccactggtgaaagtccggatttatttctcttctctattgcctcctttctactctctaaaaacagagctgagataagatcgtttctcactctaacacagctctgacatttcataaatctttgtcctagacaactggaaagggctatatttaaccttccgtcctgtagcttttaatggagggacttgcttcaggcactgccttctaatgccacaggagaccagagtttttctttgttctctaccagcagagccgcgacctcgacagacagaggccacagctggcctctccctccagtgagacgcacaagttgcttggccaggcatcggccctagagcatccaccttcccctgtctctaggtgaaggaggtccctgtcccaccctgtgaagtgtgacccttcaactttcttatctgcatatacttgaaagactcctcattaaccccatagctgagataagtgggccaggtgagcacaagaataggtcagacagggcctggaggtatgggcttgggagtctgggctaggggagggagccagagagaagaaaatgtatggtcaggaatctggttgcgcagggtgcaggggcgagggtggggaaggaagcaatgctaagtaatgtaccaggcctgtgctaggagctttgcattaattgcctcccctttcctgcctctccttgcctacatgccttagtattgcaaaagtaaattcagcactttagcaggagtccaggaggcaaataaagcaccaagattgactgagatgcattgtctttgcattgattgtattggttgtgtgatcctcacaaaaaccctgtgaggtgggtaccatccttacccacattatactccagtgaggaggcttaagtgactgaaatgacttaccttaagtcatacatagttaggaagcgacagaacagggattgaacccaggcccatcaaactccaaagcttagttgctttgcccagtcccaggatgtccctggctgacctggcactgccctttggagcagctctgatgtgctggcctctctcatttccttgggtttcttttataaacacttgagcctctggtaggttctttccacactgcccatcacacaggcctcaggcccaccgccaacctcggccaggctgaagagcgcagcagtttgatatctctgatggtgccccatgctctcaggcctcatgggctggcttctcccacattctgtactccagccttgcagataacagctactgggatcagtagcctaaaacaatgaactatactattgttttttttcatgttaacagttccctagactgctaacactaaccacctctgtggccttggacaaattgtgtcccttctgtggtcccagcttccccagagtgggaagataagacactctctctggcccttctgattcaaagagtctaggattcccagggtccccctctctccagccccaccgttgctggttcccccctacagtgttgggatgagggtagccaaaggcactggtttggaaaccttcgctgagccaagcaatggctccagagccaatggccacagcgacagagtggcaataacaaccacatttgtaggctactttagtgcttaccaactgttttcacagtctgcgaagtggcagggagggaactccaaggcgattttaatggcacatagtacatctttaaagaacattgaattacatggtgagaaaatgattctcttttccttctctttccagctttctgattacatcaaggacaaggtctcagtgtggtgctattcttcaacttctgtaatgcttactaatcttcttttgtaacaaagctagagcaggcctcaggctcaaagacatggacaggcaacaatatctacatagaatttaattactctcttctgttctcattgtatttctttatacagccactttctatttatggcaagtgatactccttttggttttggttatggtttccatatagaatttcttttaatatagatttatttgtttaagaaaaaaaaacaattcacttagagaaaaagattaagtgaattgtaaatagaaccagtggtgcctacatacagcaaaacttgtgaaactggtaccctaatggccaaaacttggggaacactggaatgtggcattcactcagcaggtgttttctgagcaccaagttcctaaggcctagaaggccctgcacgatctgtctctactcttgtcccagattttattgccccttactccccctgcccacacactgtcgtgccttccagcatgttgcatcctttttctggaatgtctttcccatatccttgcccactcatcaaacctcagcttatccttcaagactcagtttaaatggcacctcctccaggaagccttccttcaaatcccccaggttaagttcagcttagcaccaggttcatgtctctattgtagcatctctcacattcccatcattcacttacaggcctatatcctccacccttggttgccaatgcattttataagaaaagcttgagaagagagggggagagagaatataactgtgagtgaggcctatgtcagtgactggtcctggggactatcacagctcctggtgtcacttggaattgaggctttccagatgccaagccagagcctgcacaggccacaaacccagcctggggtctgcaggtcacatgcgggaagtttattggggtactgctaggatcagcatctagagtctaagggaaagatgcaggactggttggagggagaaattggactatgatgctgtcctaatgacagcctcagctgacacttggggagctctggagctgggttggtcctttagagttgttctgagtcagggtgaggggaccagtccttagatgcaggctgcccccaggaggaagcatagccttgagcaaagcatctctgtctgaggaggtagctgggcacttcccaaagagggccgtcagccagcagcagttccgcggctgagggaataaggccttcagtcctgaacgggaatctgggcacacatcacagtgtccaccacacgggtctggtcagagcctctggggcttcagtgctgaggaggcagcgaggagagaacagtggtttggagggcagagtgtggctatcaagagctggcagctggtaggacctagtaaatgtttgctaaaagacagaatggctgggtatgatgttccagtcaccgggcttacaggcaaggaggttacagaggcaaacaagtcacagggaacttctggtatcaccagggcgacagatataaaaagggactattccagaacagtgcagtaagtgatgtgatgtgtacctgtgatgtgtaccaaagaccaggtttccacagcactttgttcgtgcttttcttggaggccttctattatgacccttctaacaaccctctaaggcacgaattattgtcctcaccctaaacatatgaaaacagagatccagggtttgctttagacctcactgcaagtcagacccccctggctgggatgacccccagcacagcctgccttcatagcccaggccctctcccctgtaccacccagcccctctcaaagacacatgcagttctttgcttattacatatatttcatcttgacctagccctgcaagatagcaaaataagggtgtcagaagaaagtaggtttttacctttattttcttaacctgcccggtatgctttcagaaatagatatattcggatcatatttataaccatgacattcttttttaatctggttttctttttcctgcaccttcttaaccacctgtgaaattcatccattgcactcatctgctcttccatatcttgtctcaaacttgagaaaactgggatcaaaatccagttagttccttttgagctgtaaggggggaaatacaggtattttaaaatgtcagccttattcaaaaaagcaaaactttcttggtttgaaacactaaaaatgtgtgagaccaagaacacctctgattttctgtatgatcactgctctaggagaaattctttgttttttttttgttttttttttttgtgggggggtatagtttgaagaaaataccacatagaggcaactaaaaatcctctttgaggagttgggtcccaggcagtgcagctgctccctactccctccctaccacccgtatgctgcgccctctcccccacctttgtgcccaccctcctcctcaaactccaggccaagtcctttttctcctcttccttccctgcctaaaagattcctcggggcctccttccctgtcagatgccaatgaagacaaattttgaggctgaacaaaaagaattctagcatctctcccaatgggcctccttgtggtctgcctggtcccagagttcacctaaagcacagcttttctctagagctttcctagcagaagtcataatgctgtagggaaccaacagttgttttgtgttccagaggagaaagatgttccagcttcatatgttcccagcaataataaagatacacatgttctgtagccctcacatgacttcatttcccatcactaccacaggaccctaattaaaaatttcctttctctttggatctaccaaaatatcttgctggcctcgttggttaaacaagggggccctcatttctcatacttccttatagggagatgcagtaagtaatgggggtcacagggaggcgcaggggtcggctttctgctgtaagggttagcaaggtaggctgggcttggtggcttacgcctataatcccagcactttgggaggccaaggcgggcagatcacttgaggtcaagagttcaagaccagcctggccaacatagcaaaaccctgtctctactaaaaatacaaaaattagctgggtgtggtggcaggtgcctgtaatcccagctactcgggaggctgaggcaggagaatcacttgaacctgggaggcagaggttacagtgagctgagattatgccactgtactccagcctgggagacagagtgaaactccatctcaaaaaaaaaaaaaaaaaaaaaaaaagcaaggtaaataaaccacccttatcaagatgtaattttcaaaggggtaaaaacatgagtctcattcaaatgtataatgatcacgtgtcaaagatttatttaactcattacagtaaagctgattttttaaaaaagatacgagagttaaacatagaattaccttgaaaagttaaacatagaattaccatataacctatcagttccacttctaggtatatacccaaaagaagtgaaaacagagacttgaacaggtatgttcagttgcatgaatgttcatagcactgggctgtgagagggcctgggctatgaaggaaggctgggctgggggtcatcccagcctggggggtctgacctgcagtgagacattattgacaatagctgaaaggtggaaacaacccagatgtccattggcagatgagtagagaaataaaatttgggatatccataaagtggaatattatacaaccaaaaaaaggaatgaagttctgacacatgctacaatatagtttagtcttgaagacattatgctaaccgaaagaaaccaaacacaaaagaacaaatattgtatgattccacttatatgaaacatgtagaccagaccaattcagagagacagaaagttgactagaagttaccagggcctaggagagggagaaataggaaattactacttatcagttacagtgtgtctgtttggggtgatgaaacattttggaaatccatagtggtgatggttgtacaacattgtgaataggtttcatgccattgaattgtacacttaaaagggcaaattgtgtcttacgtatattttactgcaacaaagtagttttaaaaaggtgtgagagacttcacaagaatgctggaataagatttaaaagttggggccaggcgcggtggctcacgcctgtaatcccagcactttgggaggccgaggtgggcagatcacgaggtcaggagttcaagaccagcctggccaacatggtgaaaccccatctctactaaaaatacaaaaaaattagccaggcgtggtggcacgcacctataatcccagctactcgggaggctgaggcaggagaatcgtttgaacccaggaggcggaggttgcaatgagccaagatcgcgccattgaactccagcctggatgacagagcaagactccatctcgagaaacaaacaaataaacaaaaaaagttggatacaaaactggttagttctggccgggtgcagtggctcactcctgtaatcccagcactttgggaggccgaggcgggctgctcccctgggaggccgaggcgggctgctcacctgaggtcgggaattcgagaccagcctgaccaacatggagaaaccccgtctctactaaaaatacaaaaattagctgggcatggtggcgcatgcttgtaatcccagctactcgggaggctgaggcaggagaatagcttgaacccgggaggcagaggttgtggtgagctgagattgcgccattgcactccagcatgggcaacaagagcgaaactccatctcaaaaaaaacaaaaacaaaaactggttagttctacagagtaatataacggtaacctttgtggctgccttttctaccggacagaattaattttcatttctaccagacaaaaatcatttgcaacttctccttcttctacaagttaacttttaactttaccgagtctggaacttaattaatagggaattgtaagtcaaacagctgcatggatggtgctctcacatgctcctaaaagggtatcagtgatattttttgccttgtggttaagttttagataatttttcttaacaccttaaataacacatgacaaagcacaactcccacatgggtctccgtgaaatggccttgactttggcttcaaggcctgactcttctgggcattaacaccttagtgacattttctggggtcccttatgaagcctacttcagtccatactacacatcaccaccagactgaccaggctgcagtaatctgtgattgcaccactgcactccagcctgggtaacagggagaccttgtttcaaaaaatcataataaaaaaaaagaaaggaaaaagttcgtctgggtaccacctcaaatcgctttcatttcatatttgattgtgttctaattcattggtgcgttggcctcacatgaagacggcctttgtctccttccagcatgcagccctgacctaagcacttggcaagtcctcactacatacccttcggatggccgattgtcctgtcctcttcataagcttgccatcagaatgctgatgactttccctttgcccctttactgtgcacagagtcattgaaaacacatttcctgtcctccagggacttatattctgactgggggaacaaaagcaggtgtcctagactagtcaggaagatctaggttcctctagatcactttctacttgtgtcaccttgaacaagaagcctccctacccctcagtttcctcatcaatgaaatgagaataataatgtcaatacttgccttgcctacctcgtgaaatggacaggaggatttgttaaaaaaaaaaaaaagtaataattgtggaagtgcttcgtaaacaaaagagtgattattcacattatagttaaatgattctgtggaagttaactagcaatacaagatagcccaataaagaatgtcacaaggcagcttcccaagctcagaatgagtccctggggtactcactcgctaatgggcaagaggattccagagggcttgtaggaggtggctgggtctatagcgtgagtgaaaggaagttcaatatactaggggtggagtggggaggaagcagtatctaggtgcatagagcatgagggaagcaaattgaataagtgaagaaagatgaacacctgcttggggctggggaggcatcccagtggcctttccagaggaaagtgtgaaggggcagtgggagaaaaggtgagatgcaaccacagcaacacccaagccaggcttgggagctgggtctgtctgctctgagaagccactgggggatctgggatggaggagtgtagaaggaaaccaagttttagaatgcagatccctctaagagtgggacttgttatcctgcctctaatttatcatttgtgcattttattgtaaaataaaatactaacttattgtacaaaaaaaaaatctaaagtgaatcaacaagtatttagggtaaaaaatgaaagtctgcctttaacttgaccaattctagtctttttcgaagactacgcacagtaacagtggggctcatatcatcccagaacttttcctatgaatatgcctgcatgtgtgtttgtatttatatcttgtttttgtcgttgttgctgtttgtttgtttgttttgttttgttttgtttttgagactgggtcttgctctgtcacccaggctggagtgcagtggtgcaatcatggctcactgcagcctcgaattcccaggctccagtgatcctcccacatcagcctcccaagtagctgggaccacaggcacacgccacctcacccggctaattttttgtattttttgtagagacagggtttcaccgtgttgctcaggttggtgtcaaactcctgagctcaagcgatcctcctgcctcagcctcccaaagtgctggaattacaggtgtgagccaccgtgcccggccgtatctttttacataaatggaattatttatgtattttacaccgagccttgatttttaaaacttaatatgtctatggacatctttctatggcagaatatatcttcttttcaatagttgtatagtattccttagtaagaacgtaccacaatttatttaaccaatcccctattgatgaggaattctgcaattaattttgcttttgcttattactattacatttttaaagtactatatgtctgtggaaagaaattcaacagtgtaaaagactatttcatgaaaaaagtcattctcctgcctacccctaaccccccatccccactttaacagctcctccctcaagaggcaaacacagataccagtttctagtgtcattcccaaaatgacctgtgcatatacaagtgtatgtgagtgtgtgtgtgtgtgtgtgtgtgtgtgtgtgtgtgtatggagagggggtggggaagaaagatagagaaagatttttaatgtaactgatgacatactatacacaacattctgcaccttacttttttcacctgacattgtatcttggagaacattccacatcagtacatatcttagctacataattattattagtggctgcagagaattccattatatggctgaaccacaatttatctgacccgtctcctactggagttgttgccagtattttgctgttacacatagtactccaatgttcatgtgttctttgttcatgtatcttcatatgcactaaatctatactggaaagaagtggaattgttgggtgaacaggaatgtgcattaaaatttttgacagttagccgggcgcagtggctcacgcctgtaatcccagcactttgggaggccgagacgggtggatcaccaggtcaggagatctagaccatcctggctaacatggtgaaaccccgtctctactaaaaatacaaaaaaattagccaggcgtggtggtgggcgcctgtagtcccagctactcaggaggctgaggcaggagaatggcgtgaacccgggaggcggagcttgcggtgagccgagatcgcgccactgcactccagcctgggcgacagagcgagactccgtctcaaaaaaaaaaaaaattttgacggttaatgccaaactgcccaccaaagaagttgtttcagttgaccctgccactagctgtatataggagtgcctattcctccatatcctctctccgcatcacagcatgtgataagccttttaaatgtgtgcttggagagcaggatgagaacctgaggtggtgggggtgggagtgtggtcagggaaggcagagattttccagttgttccccatgagtatggttgaggctctcacaatagcccagcggtggatgtagcccacaagtgttgtgtccccaagaccttaggtgtctagcagcactccaggatacccatgatccacaaacccacgtggtgcaagtcctagagtgtcaaaagagattctttgatccttactaccctctttcagcttcatgcagaaccatttctgaatctcaagccaggactaggaagcctggattggaagccagtttgctggcagaggggggcctccagcaaaatgtattttaattcactgtcaccacatgcatgcacacatgaacacacacacacacacgcaccaagaggaccaaatacagaactcaagatccaggttcagaagtgcaagcttgtgccttgtgaagcacagctcttcatagtatgagtttccaagagctgtaggttagatggcctgtttcaggttgcgagaacaaaggtgtgcttccgtttccttgggcgatgggacataagtgtaagaattaatgcataagtgaacccctccctggcagccactgctcttcacaactgatgtctcaggagtgctggacaagactgctccccacgactttgctttccccattctccatggctctgctactgctgtctccctgggcttctcctgggttctgggccacctcactgcctgtgctcctctgtatgtatctgtcacatacacgttccccaagagaggggttcttattgggtcaattggtcactccaccttctggaacattcttatcagcctgagtgctcagtgcaaagcacctcacgggcctctgggcaccctcagacccaactgaaagatggctacccttgactcaggcccaggctgtctggtgtgtccatttgtgacctaaagaacagtgcccggcacagagtagccactcaacaaaatatttactgaatgagtaaatagtgatccaagattgaggaatccctctgtcaactctgttcaggaggaggctgtgagtgagggaggcatggggaacattgttggattcctctttgatattttagacttaaggccaaattcagcaaattcattaactgcattaatacttctatctccaaagtgaagtattgagaagaacacaggctttgtaacccaacagatctgagttcaaatcctgactatcactaactgtggtgaccttgggcaagtttcttgacttctccatttccttaccaataaaatgaggcttatagtatctcccttgcagtgttgttatgaaaactagtccagacaaagaatgcaaagcacccacctcagtgcctaatgcataaagacattcaagaagtattatctgttgagaggattcgtgtcatttttcaagttaaacttcctgacttgtgtctgctaagctcctggtaaatgcaagtgtgcttgtgtttctagagataagtttggacttctcaagtcaacacacagccaggtaccacaaatatgtctacttcttgatgttcacaactaaaggaaaaagccttttatttctcttgttcaattagctttgagacaaggcaagccatctcatcaatttgctaatattgctttcaaatatttataaagtctgtctccttatgatggttctataacctgagttctaatctattctctggactgtttacccagatatattggaatttgttgccaggaaaggtggtttctctgcagatgtagaaccttggccaggtccctacatggcagtagtcaggttatctccatccaatacacaagcagttaccagtcatttcctgaatacctggccttgtgctgtgagcaacattatttcttcaatccaggagtcaaggagatggctgagaaagggcctgcttccttccaaagtccaaggtattctatagggtgggtgacccacaggttgtctgcctcaccttccattgatagatgttgaggatgcttccattttcaccttattactagcaatggagcaatgaacatccttggacttatatctgtgtgcgtgtgtgtgaatattcccctagtatagcttgcttgctttctttctttctttctttctttctttctttctttctttctttctttctttctttcttttcctttctttctttctttcaaaacctactcttctctgttgcccaggctggagtgcagtggcatgatctcagctcgctgcagcctctacctcctgggttcaagtaattctcctgcctcagccacccgagtagctgggattacaggtgtgctccaccacgcttggctaatttttgtatttttagtagagacggggtttcaccatgttggccaggctggtctgaaactcctgacctcaggtgatccacctgccttggcctcccaaaatgctgggattaccggtgtgagccaccgtgcccagccctagtatagctttatgaaagtgcagttacagcatccaacagtgtataaatagttactttaaataagtaccagaatattaccctcaaaaaggcttaagaagttacacttccaccctttacctcggttattgcactcctaggtctataccctagagaaactctgagacaggtgaatgatggcatatatgctgtgaatgttcatgatggcaaagaatggtatggacaatttgatgcaatttatacagtttaagaacatacaacccatactgtatagtttattgtttatgagcacatacatagcacatttcaaaacatgcagggggctttgactcaagctgtagtattttatttctttaggaaaaatgttctggggcaaataaagggaaatgaatttgttcctgatattttttcatatgcttgaaagagttcgtcatctaaaaaaaaaaacaagacaagaaaaaggcagggcaggttcacagcccctccagagcccacccttttgttcaagggcacctggtacatcagagagatggataacctccatgggaagagactttgcaccccaattcactaagagccccttctctcccagacatcagtataaatccttaggatctattgcttgagtaaccttatgattctcgacttccaggcccaagagaatgataaccaaatttttgcagttgtcaccctaacactgggacctgcctgcctgtccatcatggagctctaagtatacttgaaccacatgtgaggagtaattggggcaaattttagattcaaccctggatttggcaatgccctttaccatgagcccaccattgcaacgcagggtgcagtaaagcaagagcattgcaaagctctttctgaaaccagaattttgccataatgcctcctgctaacagtgttgcctgattagcagacacaatgggaccatcaggccttatcagcaccacttggtctaaaacagaaaccaggaagggctgtctctcagtgcttggcccctgttgccatggcccctgttgccatggttcccaagcacttttgcttatgatttctctcaatcgcttatagcatccatcagcaagcaggacctagaagctctttcgggcagactgagaagaaagctgtaaacaggaaagataagagcaagtaagggaagtaattaaacgagcaaacaagaaatgtagatggaaagaatttggggtgaggcccagaaaacagcttttgttatgtaaaagaaatcttcttgagatgtgatagaccaaggtgtctgggtcagaatttgccaagaagtgcccattatgtagctgccatgtggtataggtacagcaactctgtgccctggattttccagaaaagtcccagtttcaagtattttattctgtttgtcagaccaagaattctgatttgagattcagaaaataaggtcactgtagttagagtagtcatccaggaaagcctgatttagaatccattgtcctcccgggctggttggcagggaatccccacaggacttgcctctagggccctgaaggcctgagtaaagtagccccttatacagccaagaaatatcaaagtgcctctcaactccatgccctccacactcccgtagctctctgaggggtttagccagaaaggcatgggcttttgacccccatagacctggatttcaatatgctctgcattaactctgccaacataggcaatgctctgagcctcaatttcctcatctgcaaaatgagagcaataacacagggttatgacagggttattctgagcatcaaatgaagtttttgttacctttaaagcactgtacaaatgtgcactgctaaaatccattccttcattcaacaaataagtgtctactacatgccaggcatgaggccaggcctgagattacagtggtcatcaaaacagacagggttcctgctggcaccctgagctttcaggtcacaggggtagacatattagccaaagatctcctcatccgaggtccaagcagaagggagatgcagtagggctgctcttttaaaaagctgactgtggctgcttcgtagagccagagggcaggagagggggctgggaggccacttaggagacttctgcctgcaatagtggcttggtctagggtggtggcagtgctgatggtaagaaatggccagattctggacagatttggtaagtagaatcaacggaacttggtgacggactaacttttgggagtgaggaagaggcaaggagatattttagctaactgtgtccccaggacttgggccactggagcccataaagccaatcccaaggctggtgaggtacaatgtatggagggtccatttctccttatctcgcctctgtagagcagtatgatgtcagtccttcagtccagaaatcagcttgctagacttaatctgaaaaaagcatttagtacttaaaaattgtataggataatatatggcattctagctttatgttgaacgcagaattcctcttaaaggtaaattgtttgcttccaatttttaagttgttttaaaattgacaaatgtaattatttgtacatatacatggggtatacagataatgtatagtgatcagatcagggtaattagcatacccattatctcaaacatttatcatttctttgtgttgggaacattcagtatcctccttctagctatttgaaactatatattatcatttgggttttttaattctttcttcttttagagactgggtctcactgtgttgcccaggctggactcaaactcctgggctcacgcgatcgtcctgcctcagcctcccgagtagctgggactacaagcacatgccaccatgcctagaaatgatacgtgatttttaactatagtcatcctgcaatggcatagaacactagaactttttcctcctccccagctgtaattttgtataatttaacaaatctcttcctagccctccaatttttgaatgggatattactttaaaaatagctgagttaccattaacttaggatgctgaaaacgttcttcagtctaggtgatctcttctgggaccaacatatgttctttgaattggattcctttcaaaccttgggcccagtagtttttgtaccaacaggttggaagagaagagggcccaaaaggggaagaaatgggaagggccacagacaaacttaagtttcataacagttaaccacacttaaccgcagttaactatgctttacagcttccaggggaatttcacatatatcatttgttgtcatattctgcaaattcaggaccatggctgtctcctgactccccgtccagtgttcctgctactgattgcactgccaggttcttaactttttgggggagaagggggaggggaaggtctctctgtgataaacaaaaaagttccaacagacattcaaaacccttctttattctaaagaatttattccatttgcattgagaaggagtgtaaaagaaaatttggtattttcccacaccacttgtcccctacacacatcaacaggtctttcatttctcagttcttgcagacccacccttcggaagctattatctgcttgacagtctgctgagacctcttgtctttcttcctctctcaattaaactctaaggactgaggttcccatctgccctggagcaaacacatctcttgttatacctgttttccagaagctggagagcttttttcctttctccaaccgctatagttctcttttcaaaacacttaaaccctcttagtgatttttaactgcaggtggcaattaaattggtttcccaaacatggaccaaaccttctctccagtgcctcctgcatttaccctgcctccacccacccttgaaccaggaaagaaaaaaacacacagacacaatttactgagttattgtcctctcttctgtgtagccctctcttaacatgaatgtggcaaaattgctaggaagaaatggtaggatgtatttccactaggtaggtctctttctccacagcggccatctttgattattgtgtctggaatcgagcagtacccaaccaacatggtgcccttcctcaggctcttccttggcgggaagacagaggcagcagttgagcaaggggagccaacagaagtggaatggctcctcattcatagacccttgtgggttttgaaggagagaggaaagagaaggtttggaaagaataggacagaaagggaggaataagaaagaggaagttggccgggcgcggtggctcacgcctgtaatcccagcactttgggaagccgagacgggtggatcacgaggtcaggagaccgagaccatcctggctaacacggtgaaaccccgtctctactaaaaatacaaaaaaattagccgggcgtggtggcgggcgcctgtagtcccagctactcagctggctgaggcaggagaatggcgtgaacccgggagacggagcttgcagtgagcgaagattgcgccactgcaccccagcctgggtgacagagcaagactccgtctcaaaaaaaaaaaaaaaagaaagagagaagaagttgaaaggggtgtttacaagtggaggaatagaaataaagctatgaattgaataatagaaactctgatttttaaaattttattttatttattttttattttaatagttttatgttacgtaaaccattatatgttatttttaaatatatgaaaataaatatatttaatggtttgttattgtaaaatgacacgtttgttgttaaaatttcaaatagtactggagagtttcaagtgaaacatacatgtcaaaatcatctagaataacagttacttgtgtgtccttgcaaacttattccgtgcatatataagcatctgtgtgcttttgatacacaaatgagatcatacaatacatactggcccattccttgcccatttttttcaacttaccaataactctgcagttttctagtttctactcaaagagatatccttcattcttcttaatggctgcatatcatccccttgtgtagatgcaccatgatgtgtggaacccatcccttgttaatggacatttaggtaaaatagaaagtctagcaccacactatccaatagaaatataatgtgggccacaaatgccagccacttatggaattttgaattttgtcttagtagctacattcccctccccagctgatttgaaatgccacctttattatatcctaaatgctcatatatacataagtttgttttgaactattttatttcattcatctatttgccaattttggcaccagtatccccttgtgtaggaattttttttttttttttttttttgagacggagtctcactctgtcacccaggctggagtgcagtggtgcattctcggctcactgcaacctctgcctcccgggttcaagcaattctcctgcctcagcctcctgagtagctgggattacaggcccccaccaccacacctggctaattttttatttgtatttttagtagagatgggatttcaccatattggtcaggctggtctcaaactcctgaccgcatgatccacccacctcagcctcccaaagtgctgggattgcaggcgtgagccgccacgccggccaccagtatccccatttctagtagccacatttaaaaagtaaaaagaaaaaggtgaaattaattttaataatatatttaatttactccaatatatcaaaaatagtgtcttacaatgtaatcaaatattaaaaattattaatgggatactttacattctttgtttcatattcagtctttgaaatctggtgtatgttttacacatccagcacatttcagttcagactgccaatttcaagagcttaagagccacatgtggcttctggctaccgtattgaacagtggaagttgagcaggcagagagattcaaaatgtcacctgagctgtgtgtctctgtggttggtaggaatggattagaaggtcagacattgaggacaaaatcctcaacttcaccactcaaggcaactcatgaagcttctcagggtcttggtttgtggactccaataaattcaacgtatgctggttgagtgcagaccagaacagccgagccaagtacagtcaggcctcgcttcacaatggggatacgctacgagagaaatgcgtcattaggtgatttcctcattgtgcaaacatcatagagtgtacttacacagacctagatagtgtagcctgctgcacacctaggctatatggtacagcctatggctccaaggctacaaacccatacagcacgtgactgtgctgaatactacaggcagttgtaacacgatggtacttatctgtgtatctaaacataactaaacctagaaaagatagagcaaaactatggtatcatctaatggggccactgtcatatatgcagttgtcatatatgcagtccattaagcaggggtcctcaacccctgggccatggacccgtaccagtccatgacctgttaagaactgggtcacacagcaggaggtgagtggcaggcgggcgagcattaccgcctgagctccacctcctgtcagatcagcagcggcattagattctcataggagcaggaaccctactgtgagctgtgcatgtgagggatctcaattacttgctccttataagaatctaactaatgcctgatgatctgaggtggaacagtttcatcctgaatccatgcccccacccaagtccgtggagaaattgtcttccacaaaaccagtccctagtgccaaaaaggttggggactgctgtgttaacttacatgccattatgtggcatattgctgtacaaatggccctggcctttccacaagccgtagcatggccacagagatatagaaagagcctgagtgctcacgaggtgattatctgaggtctgtcacaggttcccctttctttgctttcagaggcatctctgttcacagcgtctcatcacactcaaaacccaatgcctgtttccttttttttttttttttcaaaagcagagtgtgtggcaacggggctctgaggaaatccctaccactgtggttggggagggtgtggtgtgaagaacccacattgtggcttactcaactgtgagatcttaactctgtggccccagagccactgtgctcctgggcggcagtggtgacagccatggcggcacagcttagagcctggaatggtaagcatgggctcaattgcatcctgcaagaagactcgcatcagggtttgagctcggggtttggtgtctgggtgggtgtcggcagaatgggaggaggcaggtggctggagagcactggggacaggtggagcagccagttttgccctggcctgagtcaggccaggtttgggaagcatttggactccacagcaggcttgggtgctcggcccctggattgacaggaagctgagaaatgtgattatctcccacgggacaacatgctgtccccaaacaaaggtggcggtcgcatgcccactgcctaagttctaaacgagccctcccccagccttttctccccaagctggccagctacaagacccaaccccatggtggagccgagggttcagagcagctaggcacaggagaaaggaatttcctcctgtggctgcctgggagggagctctttttcatcggccccacctgccagcttccccattaccaggccgaggagtggaacaccagcattccttttcccttcctactgctgcctcctccagccctgcagcctagaaactctcagtggtatcagactcctgaagcaccaggcaacagcccagcttctttctgcttggtcacacaagctgtggcctcccaaatcatgcctgggctaggaagacagagcagtgtcacaggaaatctaagtcccatgcacatggtgatctcaccccagcctctactgcttcagccccctcctgaggctggccaaagcgtagaagccctgctgattaagcctcttccctgaatgttggcagcctaggctctgcactaacttagcacctagtgcagagcctgtcacgtgcatgggagctacccagtagcattctcttggacggataaatgcatgggtgaattaacatgctttggatattgtctttgttgtacctcctcagggctcccaaagccttaaaactagaacttgtcacctcatcactttagaaccttctatttgcaggcatctatgcacctgctgatctctcccactaagaaaaggtgacaagagaaaccagccaggggattcctgagggtagtctaggagtctcgaagccttgcagtggtcttccaggctgaatcatcctacctcgagaaccaagagcatgagagttggcatcagacagacttagttcaagtctcaaccctgctatttcctgtatatataatcttagtcaaaagtcatttcaccactcttaagatttagtactctactctgtaaaatggggctaaaaatacctacccagcattatggtgaggaataaatgagaaaatgtgttaggttgaatcctatgaaactgtccaaagcatttaaatgccagcaaatttgtatggttcaacctaatatataaagtagcctttataaactataaagtataataaatagccctatataagtattcattattcttaacagatataatttgtaagtcacagaatattgtttcttgcagtattagtaatccctttcatcagaatacaggtcaaactaacagaagaagccacttatctgacaatcgtgggctgcaggcatttcctggagcattttggcctgggaaatagggagcaggtatttttaggaaactagactggttcatggaaagcaatggaggtgaacaccagggtgactcgtgacagctcctacctggaaatgattaacccgcaaaagcacagtaggagttggcacattctcttgccccagatgggagtacccactccctagctccagtagcaaagcagaggctgcctaggacaaacattccttcccgggggacagagccaaagggtcctaggccagcagacatctggaggaaactaaaaacagcttcttgccaacttttccctccctagtggcagctatcaagcccaggtagctcctcttgacctagcaaagtcccacgcctgggaaagcttggatttggaactgatagctgcagtggccacagtggagggagtgggggaaggttctcaccatattatgcatcgctccctcaatcccaatcctagatgtaaaggtcactgggatttcaggccagaggggactgggaagagtccagagaagtgcccacagatttgctctgcctccgttgctggcaccccaggccaaggactactgaagcactaaacaaacagttataaacttcctaagcagtgtttctcaccgagggcatcatggcccttgtgggtaagacaattcttcattgtacaggacagtcccatgcattgcagaacatttagaatctggtagcaaggtaagagtagagctggatgagtcccaggtccaaggttcaggagaaggatccaagcagagtagtggcctcttcacagctccaaatggcaccttggtgaaggcatcttcaactagatgctctacaactagcttgatggctgtgcactaccccatgagccaactgactgggtaatcttggttgggccatcagaaacatgtaaattcactcagacagggcctgggacttgagaggagaaaagccagagaagataccctcccagggctgcccatgggcaggcagtgctctgcacagctcttagccccaagccctggccagcctgtggcagaaggtccatgtggagagtgaggccgacttgacccagtgcccgagtaccagtttccagcatcagccaggatggatgtgggatgcgtgacattcattcagggaagtgtgaatatccaatttgagctacaatgtggactccccatagcacagaagtgcttgaccaggagttcatttacttaaatgagaaaaaaattataactttgtcttcattaacctgtaattgaaagttagctttccttccattatgaacacaggccacacatcacagtggcattagcctgtgactttgtctcgaacaggagccacagatgtttttatatctcattactgctgctgcaggtgccttaaattactgtcccattcacgactacttcaaaatcatggcagtcactggacccgccactagctcatgttacttaatgtgttaataacgaaatgcatattactatgttgcaaattttaagacatatatagataactttaaatgcaattgacttcctttgtaatcctatgtattttattttgtgcttgtagaaacattccaagtagaggcccataagtttcattaggctcctgatggagtccaagccattaaactgttaagaaatcctggattagagggttgtcaggaaatcggcctcatttgagtcaacaaggaaggccttgagtatgaagataaggagcatgggcatgtgttctgctcacattgaggggatgctaaaggtttctgagcaggaggttgcccaaggtgacgctgaggtctccagcctgggattcattaacagaaatacagaagtcaggaggaagagtggattaggatagcaggagaggttctattttaagtatattaaatttgagactaaaaaagtgggtatccaggtgaagatgtccaccaggctctgagaaatgcaagtgggcagactgggagagtggctgtggcaacaggaaagagttgaggatcatcctctgagatgatcttggggcgtttggagtgattgtgctcaacaaggaagaaaaggcagggagagaaaagaggccaaggcagggaattgtcataggctggcatctccaagaaacagatttggagatattgatttgcctgcaaaaggtttgttgggaactgccttctagaacagcacctgtgagggagcaggatcggtcagagacaggagttcacctgcagtgtgggcacactggagacctcagttgataacatgggaagctctggagctgagatgctcttcagatggccccagttgaggccaggcagctgggcctttcttcccccacctcccaccccaccccatctattaacgagatcttggatgcaggctgccccccaggaaaggggttgttaccttggagaagagactcaaccgtgagccatggaccaacacctctggtagctgggggactgagtgccttggtcctgaatgggggatcaagcagctcaaggtctggtgttctagtcactcaggaaatgcaactggctccctcccaccctgcaggcctctgggcaagtccctccctgcagcccaaagccaggtataggagtcccagggacagggagtcaggacctaaaaggaatttgagtccttgatgcctgtaattcagagtcctcagtctttcccccaacctctctcacttggggctaagataagtgggatgaggtaggcggaagttggagggaaccgtgccgttgtcatcttctgcacagtttgtttataagaggttaccaaactaagcaaatcagccaccatggaaacagtctctgtggctttcacatccctcccttccttctggggtgacctgcatctcaaagagggatgtcaccacagttgaggttacaggtctgctcacaaggcctgtgagctacccaggaaatgcaatactgttatagccaccaggtgaaagaaggttgggcttcatttttaaagagagaaatataaaaacttgactttcgattttgacgttcatgtccttacgccaaaaaatcaaaccaaatagcaactgaactgactacgtgtaatttcccccaaacctttgaaatttacagtagctctaggaaacttgaatccatgaggccgggcgcggtggctcacgcctgtaatcccagcactttgggaggctgaggcgggcagatcatgaggtcaggagatcgagaccatcctggctagcacagtgaaaccccgtctctactaaaaatacaaaacattagccgggcgaggtggcgggtgcctgtagtcccagctactcaggaggctgaggcaggagaatggcgtgaaccccgggggggcagagcctgcagtgagccgagatcgcgccactgcactccagcctgggcgacagcaagactctgtctaaaaaaaaaaaagaaacttgaattcattcattcattccctcattacacacacacacacacacacacatacacacacaaaggttctgagtttgcaagatgataggctgaaagaccaagtgtggcctgaagttcaggtttttttgttctgcatggtttaaaaaacgaattttccacactcagaagtgcagcttaaaaataaataaacaaataccatctcatgccagttagaatggcgatcattaaaaagtcaggaaacaacagatgctggggaggatgtggagaaataggaatgcatttacactgttggtgggagtgtaaattagttcaaccattgtggaagacagtgtggcgattcctcagggatctagaactagaaataccatttgacccagccatcccattactgggtatatacccagaggattataaatcatgctactataaagacacacacacagatatgtttattgtggcactattcacaatagcagacttgaaaccaacccaaatatccatcaatgatagactggattaagaaaatgtggcacatacacactatggaatactgtgcagccataaaaacaaatgagttcatgtcctttgcagggacatggatgaggctggaaatcatcattctcagcaaactatcacaaggacagaaaaccaaacactgcatgttctcacacataggtgggagttgaacaacgagaacacatggacacaggaagggggaacatcacacaccggggcttgtcggggggtgggggctgggggagggatagcattaggagaaatacctaatgtaaatgacgagttgatgggtgcagcaaaccaacatggcacatgtgtacctatgtaacaaacctgcacattgcacacatgtaccctagaactcagagtataataaaaaataaataaataaaattttttaaaaggccgggcgcggtggctcatgcctgtaatcctagcactttgggaggccgaggtgggtggatcacgaggtcaggagatggagaccatcctggctaacacggtgaaaccccgtctctactaaaaatacaaaaaaattaaataaataaataaataaataaacaataaataaataatgtaagttagttcccaatgcactttcttaaaaaatcttaagatctggtcccaatggatgaatcagctaatactaaggggtttggcccccttgtgggtaggcagggagttccacggttcacggcagggcccatttagcctgcttctctctttggtgttacctgcctgggccctgccagtgtttgtgctcatgagcccttgatttggctaagctgggtgctgaggttacacaatgatagatgatgtcattgctctgctctgctgtctcctctgccctcagggctcaccatctcgtggggaggacgactcatgtgcaccaacagacagaagacagagtcccgggggggtgttggaggaaggaacaacccatgaggaaaagcgaagttgggacaatgtcatagagactctaggagcaagggtagacttctactaggtggaaaagagggcaggggtgggagaacggcattctagagcaaaggaacaattcagctgatgaatggtgctcctaaaggaagtggcgcatgtgaagcggagaagaggcaggggccagaatgggaagaccctgtcagccagcctgaggaactggcattttatcctgatggttttgaggcagagggaagagctgatatgacttgtgtgtgtctagaagatgactctcttggccccgtggaggctggatcgtaagagagcaagatctgagggaggaagagcagcaggtaggaggttcttgtaattgtttaggtgagaagtaacagggctttgatttggagaggtgccagtgagtgggagaaggaacagatttgagagggagttaggaggtcagattgacaggtcttggtgattcctcaaggtggaaagtaaaaaccgggacccagtggcacagtggtgtgcagtgttatcctagccatggcagtagctgccctttgttaagggttctggagcatttgcagtacttgcccttacattaactcaccccagcctcaaagtcaaagacaccaaacttctgcctgtccacaggcttcgtgcagcacttcctaggtgccaggctgaagtgttgccttcacattcactcactgcgtcatcacaacttccctaggaagtagttactattcttacgtcattttacagatgaggaaacagaggcccatagaggcaacgtgaatctcccagggtcacacagctgataagcgacagagccaggatttgaacccacatcgtctgctccagagccttcgctctgctgcctgggggcgggaccagaagagtggtcactgagcacagagaccttctgcacacagagcagcctgagcaaactgcagcaggctagtagtgtgtgcatcccacacatttctccagtgagcatctagacgtgaaatcccgaggccttggatgggctttctagttccagaaatttgaggacatgcgggtccggcagggaagaaggaaacgctgagcccaggttgccggcactgtaggcagtgaaggagagcagtcaggtcacaccacacagttcccttccccgccccagaccatagaccctccaacagctttcaggtatgtcgagcatcaaaccccaattcctgaccgcagcccataagactctgaagtaatatggcccctgaccacctctgtgacatcttttcttgccatgctcccctcatacatcgcacatacactggctcctttcagtcatccttttccaccccagggcctttgcatttgctgtttcccctgccaagtgtgctctttttctctttgtgcggctggttccttcttatcattcagatctcctctgctttagtgtgaactccgtgagggcatggactgtgtctgtcctgttcactgttgtattccccaagcttatgggcccagtacacagaaagggctaagtatttgttgaatgaatgagctattttggtacctgctgtgtgtcaggcactttacaaacattaattcgtttaatcttcaaaacaaccctgtgaattaagtgtgattgttattcccattttatagatgaggcactgggaggtgacttgacttgcccaaggtcacagggcttaggaagaaacagagctggaactggaacttgactcttgacttatgctggcccccctaaacacattgctccaaagtgtgcattcaggcaggttttgttgttgtttgtttgtttgtttgggagacagagtctcatactgtcgcctgggattgagtgcaatggcgcgatctcggctcactgcaacctccgcctcccaggttcaagccattctcctgcctcagcctcccaagaagctgggattacaggtggcaccaccatgcctggctaatttttgtatttttagtagagacggggtttcactatgttggccaggctggtctcgaactcctgacctcatgatccgcccgcctcagcctcccaaagtgctgggattacaggcatgagccacctcacctggcccaggcagggtcttcattgagaaaggctggggctctgtccttccgtgtgctgctttatatggctaacttaaacttccccagaaaggaattgaagcaattctggtggcctctcagctggggttgttaaacaccctggttgttccaccttttcattcttatttattaaaaactccacagagttagagaagttcttcagaaagcaaagcagagttctctgctcaatgagaaagtcaccccattccagtaggagatgcagccaaaacccacaggacggggcatcaccccaaggatgccgggaacagaggggtgaagtgcttttctctggtcccatattttctccaccagcttcttagttgcctagatccttgctgctcaaagtgaggtatgaagaccagcagcagcagcagcatcacctacgagagtgttaagaaatacagaatctcagcacacacacccccgctccacctactgcgacagaacccgcgttttaacaacatccccaggggatttggtgattcatgtgcaaaaaaagtttgagaagcactggcctagaagacagcctctgagaatgacctcctcatcaccagactgggagctccctaaggacagggactgtatctcgttgtgtcctcaaggtcccctgcacagtaccagccacctagtaggtactcagtcgtgtttcttgaatgagtaaatttatgaaggaatctagtcacatacagccagcttaggcacagatagaatcatttactatgcatgtttgcaaccctttcccctgccgtgaccccctccagcaagctttccaacaaagaaacccaaccccagccccgggacactccttctagcctgtggtctcaagagggaggcccagcaacagggagttggtttctgtaggccctagactttggacaggacgctgaacggcttgtcccctccttgtttcttccatcctcccacctaaaaaaaaaaaaaaaaaaaaaaaaaaaacccaaagaggaacttctaaggtgcccacactgtttattgctctctttactgaggccatggcctcctcagcacacacggccaccacagtccctttcccacatctcaaatggccccctggaaattcgagttcctcccaaagtgcagaaggtgctgtcaggtgctggctaccaagcccttgctgcatgtggaaccaaaataaacccctgttgatatggaaacgggttgaattattttaagaaaaaaaaattgctccttcattaaatcgcgttgttatggcaaccggaattaggaaagtaacttggccatggaggttatgtgcaatgttttgggactgagaattttcagaatagtggaaaacagtttgtgagtgcatctccctgccccggactctgcctggaagaggaggatgaaggccagttgagcatctggccggccaccctacctgggtggacttgtgcagggtggctgggggctgctctcaggggccgagcctgcagtgatgcaggctgaggccataaaggtttatgtgggaaagacagctaactgggcggaggatgtccggaccagaggtccaccactgtctgggtgtgcaagtagtcctccactctgctgcaaaaagagtgtcccaaattcctggaattaaagagaggtgggaggctcaaataataataatagctactctttattgcgtctttactgtgagccaggcactgcactaagaagtactggacacactcatagcaacccagtgagacattattattatctcagttttgcaaatatagactgagtcttagctcagtgaagagacttgtccaaagtcccacagtaagtaagtataaggtaaattaaagaattgcagccatagcagcagcagcagtagcagttctgtagtagcattttagcagcagggaggggctacacaaccccttgacatactcacactcagtcctcctcagaagcaggagtggatacttgcaaagacagtaggttgaagtgagattcactcatttattcattcaacatgcatttaatgaccacttgccatgcgccaagcactgtgtatatgctggtgaccaagacagacaagatccttgacctcagggagcttacagtccaggataaggcaaacagacagtcatcaatgaaaccacttaccaagaaaagcttcaagtagtggtaagtgctatgaagaaaagtaagcagagtgatgtggctagggtgactaggatcaggacaccatagcaagatcaggggtctatctgaagaggtgatatttgagcagagacccaaatgaaggaaggaagcaagccatgtgaaaatcagggaaaagagtgttacaggcagagagaacagccagttcaaaggtcttgaagtaggaatggacctggcatgtttgaggagcagcaaaaaggcccctgtgataagaaaagagccagcaagcagggagaggcagaggccggatcattcaggccttatagatcatggtaaggactttgcattttagtcctgtgtgatgagaagcaatgggaagatgtgctggggagcaacgggatgtgatttacttctttctttactaatagctttcttgagatataactcacataccatgcaattcacctatttaatgcatacaattcagtgactcttagaatattcccagatatgcacaactgtcaccatttaattccagaccatttttattatgccaaaaaggagacctttttctcattagcagtcactttccacttttgccaacccctacctctccccagccactagtgaccactaatcaactttctgttttgatggatttgcctaatctggacatatcatagaaatggagtcatataatgtgtggccttttgttgctggcttctttcacttagtgtaatgtttacaaggttcatccatgttgtagcctggatcagaacttcattcctttttttttctttgagatgcagtctcgttctgttacccaggctggagtgcagaggtgcgatcttggcttactgcaacttccacctcctgggttcaagcgattctcctgcctcagcctccaaagtagctgggattacaggtgcgcaccaccacatccagctaatttttgtatttttaatagagacagcatttcactctgttggccaggctggtctcaaactcctgacctcaagcgatcctcccacctcagcctcccaaagttctgggattacaggcatgagctaccatgcccaaactttatttgtctttttattattgagttataagagatctttattatattctagatacaagttccttaacagatacatgattggcaaatattttctccatttctgtgggctgccttttcattttcttgatggtggcctttgaagtgctaaagttttcaactttgatgtaagttcagtttattttttcttttgttgtctgtgcttttggtgtcatatctaagaatccattgcctcatccctgagtgacttttgaggatgattcctctggttgctgtgtgggaaacagatgggaggtggggttgctcagtagctggcaagaggaggggtgccacctgccgtgaggggtgctctgtacacagcttgccgactcccctgtggaccaaatgctgaaccctgctgttgtgctagacccctattgacttcagtagggatggcaccaggttcaagaggccaaagaggagacccatagccagcaaacgagacatagggttttattagagggaacttacttacagagatgatccagtgggagcaggctggacaggagaaccacaacgtcttgcaaaaagcatgcagtttatatggcaccttcacttagcaccctcccccagcaaccgctatgtgacaaacctcatttcttaagttattgctgtcaggtgcgcctaccatacacctgcaaagtggcctggacccaggcacagacatcaacaggctggtttcgttttcctacatttctcttatgccagtcccattttctgctcctctcctggtttgaacctgattgggcaattcagacatttggaaagaggctcagagccaggtcagaaggtgatctggatggtctcttggtgcctggggaggagcccccgtctggctcagtgtggggcctgagaagaggtccttcctctttctgaccctcagtttccacatctcttctgtatgaggggctggactagggcctctgactgcccacaggcttctgagtcttcattttcccattctcatagggaggctgaacatggctggcagaaaatagttattgtggtaacgagagagagttgaagtaaaccacaaaacaatgtttacagtatgattccatctttgtttggcataggaaaatttctggaaagatatacccaaggtatcagccgtggttgcctctggtgtgtaggattatgaatgttctttccctctttctgtttgtttgtacgttctgatttttaactatgttaagcatgtttcgcttttgtaataagaacaaaaaagaaaagcataacagaaaagcatgacaatttttaaaagagagaattgcctagaagccattaggaaacaaagggagtgggaaaggtagcagcggcctcctctctggagcaggcctctgagccatgcccgagcccacgagagagcatatgtcaatgcgcctctcacactgcaaagggcccttcctgccagaggagtttggaggccccaggaagccgaccctgaggcagagattagtgtgcaggaagtttgttagggggcccttgggatcaacaactgtggaaagtgggtgaggaagcaggattatgcagagggagtaacgtaaactgcaacaaaggtcacagtcaatccaaaggggaagctctggaggtgagaaagccccacagagctgccctgagttgaggtgagggagccaccctggcaagatgtgacattggacaaagtaatccccaaagagggctaacaacaaaatgccttctggcagctcagccaacatttaagagaataagttgtttatccctgaggtggaaccttggcggcacatcacagtgtccactataagaggactgtttggcagaggtgacctccataaaggcaagccaataggcagatatgaggggaatttgggaagaggaagaactcatctttgaactcagaagcctggcttcatcttccactccgagctgtgatctccattcctgatttgtctcctcaggcagtgacctttgaagcagcgataggccaatttatgattctttaattgccctggaatgcagacagggtggaattattattggcctcattttgttaatatagaaagctaagttcagagggaacacacagcgaggtcgtgatgaggcagagtctcaaagccaggtctgtccaactccatgtcccaacttctttccctgttaacacagctgcccaaattttcaagcaatttgggttgtggtcagatggacaaatccgttcctcctcgttaacactgaaccagtttgttctccatgtccggcaatcaattttcagatgagctggtcccaatcctgcagattacaaagtcaaatttgactcagttgatgcaacctaaagggccccttactgtcctgaaaagctgctgtctttggaggaaggtagagctgcctcccaccaagaacaatcctgaacctcccgaagtttggtgggggcggggggggggtgcggggggcgtgagaggctgcagggagactgactgagttaatcctgagttaatcttattaacctatgagatcaattggctacaggcgccaggcaagtgacagcacaggcattaattcagcagcggccagggcagcctgacagccaggaactgatttatcagggcttttaatggatgggattgcatttagctaattgagtctggggctggcacggataagacaacccccttgtgatatgcaactgctcagtggatgtcctgccattgtggggggaagggtgacagaaggaaataagaaagcacatgacaaggaatgctcccttcctggccactgtaagggctggtgttgggttccaggtatctctaacatgtgagccactagtgtagtgtagggcagtgattctcaaaatatgatctttgcaccagcagtatcccttgggaacttgttagaaatgtaaattcctgggccttccccaggacattcaaactcctagacagtttgaatgtctaggagtggggcccagcaattcgtgttttatcaggctgtccaaagaattctgatgcacacactcaagcttgagaccccctagaggagttatgagtgcaaactctagtaccaggcagcctgggttatagtaactgtgatgtcggacaagccatctaacctctcagtgtctcaatttcttcatctgtaaaatgagggaaataatagtacctgcttcatagggctgtcatgaagattaaatttgtcaagtgcctagagcaatgcctgtagtaagggctatatatatataaatgttaacaactgttatcgttggaaataatggagcctgggacttctgtctgctcccttagtatgacagtaattctaactggatcataaagtttcctgtgatttgataagtaaaaaaatatggcacaaaattttatcttcactgcgattgtacttatgtaaaaatacttatgcacataaacaaggtgaaattatggatggtttctttctctaatcacaaacctttgaaatgtggttaaatataatagatctttgagatccaaatattaaataaattcagatggacaagaaaaacatattgaatcacaagataagcaatggacagagttgaagtagaggctactatagaggactcatgataaaggactgcgtgcgtgggtccccactccactcaggggcaggggcgtggttctgggctcatcaggttacactggagaaaatcaagctcaagtttcctcaaggttagaagggaggagacgtgagcaagagtgtggtccacctgaggatgcttaataacagtagcaaggatggctggccccagtgaggacagctagggggtgctcatggggtctccctcatcctcagggagggagaaagaatccagctaagaaccagggtggtcttggaagctgagaaacttggctagctgttatgggaaagtctgactattttttgagagtgccaactaaatctccatctataaaggataagtacaactagtcagtaggtttttatctccattttgccacctacatatctataggtaccagggtcttacagattgggctgtgaaatcctggcatagggccaggagagctgatttcaagatcaagacccaggtcagatgattggggtgggcatgtggtgagcttgaaacttcacataggcatgctactctcagccctattttcccctttaaactagaacaaagacactctagtaagagtttactgaggtctgagtatggggcttgtctctatagtatatatctttgcatcccagtaaccagtttacttttaaatggtagcatatctgttgatacatagtcactataggatctagtatgatgcactagaatttctgcagtttatcacagctgccctgatcacattttgtggccattcttttgatgcttgagtatgatattgtggtatgtttctgacttaccaaggttcttttctgataacaactttattaagacataaaacatgtgcaaaccacacaattcatccatttgaagcatacaattcactgggttttaatatatccagagttgcacagccatcaccacaatccattttagaacaatttttcatcccagagagaaactctacccattatcagtcactccccatttcccctcaatcgcctccccagccctaggcaaccactaatcgactttgtgtcttaatggatctgtctattctggacatgccataggatcaaatcactgactatgtggccttttgtgactggcttctttcacataacatgatgtttcaaggtccatccatgttatagcatgcgtcagtacttcattcctttctgtgactggataattccattgtatggatagaccacatttttatttatttatttatttatttatttatttatttatttatccattcaccagttgatgaacattttgactgcttccacttgttgggtatggtgaataatgcagctatgaacattcatgttcaagtttttgtgtggacatatgtttccaattctcttgggtacatgcctaggagtggaagtgctgggccaaatggtaactctgtgtttaacattttgaggaactgccagactgttttccaaagtggatgcatcacattacattcccatcagcaatgtattaacacaagggtaccacttcctccacatccgcaccaacatttgtttgacttttttattatagccatcctagtgggtgtgaagtgggatatcattatggtttttattagcatttccctaataactaatgatgtcgagcatcttttcatgtgcttgttggccatttgtatatagtactatcttttgagaaatgtctgttcagatcctttgcccatttttgatttggattattatttgtctttctcctttgatttgtaagatatttttatatgttcggacacaagtctcttatcaaacatatgatgtgcaaatattttctcttattttgtaggctgccttttcgcttttttcttgagatagagtctctgtcacccaggctggagtgcagtgggaccatcatggctcaccgtagcctcgaactcttgggctcaagcaatcctctgcctcagcctcccaagtagctggtactacaggtgcacatcaccatgcccagttaattttgtcttcctcttgtagagacagggtcttgctatgttgatcaggctggtttcagattcctggcctcgagtgatcctcccatgtcagcctcccaaagtgttaggattacaggcatgagccaccgtgcctggtttctttacactttcttgatggcattatttgtgaacaaaagtttttaattttgatgaagtcaaatttgtgtttttctcttatgttatttgtgctactaatgtcatatctaagaaaccactgcctaatctaaggccttaaagatttatacctgtgtttccttctatgttttatagttttagccattacatgtgggtctttgacccattttgagtttaattttgtctatatatgagaatgaattccaacttcattctttggcatttggatattcagttgtcccagcgccacttactgaaaagattattcttttcagcattgaatggaattggcacccttgtcaaaaatccatcagccatatatgtatggatttatttcaggactctcaatttctttccactatatggatctatatgtctatccttatgttagcaacacactattttgattactatagcattgtataaagtttgacattgggaattgtgagtcctccaactctgttctttttaaagattgctttgactgttctgggtccccttaatttccatatggattttaggatcaggtggtcaatttctacaaagaaattggaattttgatagggattgcattgaatctgtagatcaatttgaggaatattgccatcttaacaatattaagtattttgatccatgaacatgtctttccatttgtttccacctttaattttgtatcatgtttcatagtttttagcatacaagtttcacgccatgtttgttaaatttattgttatgtgttttattcttttgatgatattgtaaatggaattgttttcttaatttcattgcaggttgttcattgcaagtatacagaaatataatttttaaattgatttcatggccttgcaaccatgttgaacacaattattagttttaatagttttttagtggattccttaggattttctatgtacaagattatgtcatctctgcaaatatgggttacttctcccttctaatccatatgccttttatttctctttcttgtctgactgttctagctagaacctccagtataatgttgaacagaagtagggaaagtggatacccttgtcttgttcctgatcttaggggaaaagcatccagtatttcacctttaattgtgatgctgttgttggttttttatagacgccctttgtcaggtgatggaagttcccttctattcctagtttgttgagggtttttatcatgaaagagtgttggattttatcaaatcatttttagtctatcgatatggtgtattacattaattgattttcagatgttaaaacaatcttgcattcctgggataaatcccacttggtcatcgtgtatgatcctttttatatgttgttggatttggtttgctaatattttgttggggatttttgcatctatactcataagagatattggtctgtagttttttcgtgatgtttttgtcagtttgggtatcagggtaatacaggcctcatagaatgagttgagaagtattacctcctctatatagcttgtgaagaatgggcattaattcttctttaaatgtttggaagaattcaccaatgaagtcatttatgtctgggcttttctttgtcagcagttttgattactactaattcaacctctttgcttgttatttgtttatttggggttttgatttcttgtccagccatcttcaatagtttgtgtctttctaggaatttaagcatttcatctaagttgtctaatttagtgtcatacagttgttcatagtattcctttataatcccttttgtttctgtaagggtgattataatgtcccctcatttacttctgatttttgtaattggggtcttctctctttgatttttggtcaatctagctaaccaaatttcttttgaattcccgtttggccctccgcctccttctgcctatacttgagagccttggccaacctaagaacatacatatatgtcttttacagtcaagaaaatgagtcttttctacactcctgcatgtggagctctcagcctgaacctccaaagcatattgttatgtctcctcagctaactgaggcagattcattctgaaccagcttctttattagccagtggctatggtgcatgaggctgtcaaaattctaccctctcactgtggaaattaagctgcagcccttttagtatatggccaccagccaagtgttgctcatttgtgactaaatatgagggcctggggaagagcagaaggcagcaggccctggccagccaggacccccacgcaaggcattgtggatacgcctggggcctgctcttcgtgagtgccactcgctttgagtcttgaatgggaacagaggcaagttagaaaagcagaggcctactgctgtttgggccatatgtctccttggtcacggcacccaggactgtgcttctctatttggcagggactcagctgacagacggtaaagtcaggaagtcaggaaaaagaattggggattttgggcaagtgctaattctggctagtgttttggggtccctggcccagttggtcatctttccccttccctctgcaagccctaagcctggctagggtgctagtgtggaaacattcattagttctgaagatgtcttagagccacatgtccacttaaagattatttccagactaatgaaaaatctgtgtgtgcaagcaggtccccattttaaaatggagcaaagcccaccaacatttccatggtaaggaaatggcaacaaatcaactctttgggatgagtatgtagtgagcttgaaactcaaaccaagtgtgaccgcctcagccccaccctgggctgctgactcaggaccaagaggaagagggagctgccagacttcacaatttctgtaaacagttcttgaaaaagaaaccacacacttgtctttctgccagcccccagcttgtccccgtagctgacagcgctgccattgtcttttctctgacaccctagggcagggcttcttaacttgagctccatggacctccaaggggtgtgtggagagaatttagagggtctacaaacttggatgggaagattagttgatcttttctccatgaacctcaaacaacaatttagcattttctcaaattaggaatgtaagtgacaaaccacagtagtgttagcggtatctgtgactttatcaccaacagaaatcacaaatattttcatatcacattactgttgttgtaagtatctcaaaaaatcatttgtgttcatcaccacttcaacatttctaatctatagaattgccactaaatcttgtgatttagcgcattatgaaagtagtaacacaactagatcacaaaatttaaaaaatatttttctaaccatttcggtatgattgtttgcctttgtgattctatgtattttattttatgcacgtgaaaacattattctgagaaggaatccggaggtttcaccaaactaccaaaagcgtccattacctaaaaaaagaccaagaccctgccctggatcttggaactctcctgctccatgggcctcacttctgatccacagaactttgcctatcttactggaggggtcaaaagcacttgcatgttagtgctgtgacactggtcaggagaaactttctgtgcctagtttcttaatctgcaaaaggcagaacaataacactacctaccttatagggttgtgatgattcaatgggttaagaaatgtaaaccacttaatgcccaatacacggtaagcactattagctatttttgttgttattgctggtttatatcaatcatctcattaatatatgctattattatctcaattttcagaaaaaggaaactggggcttagaaaagtgaaattactaagtcaagggaacacagcaagggagtggcagagccagggttcaaagccaggtctatgtgactctcaagcccagtggaggtcactctttagcacactactgagaggaggtgatgtccctcagagaaatggaagccatcaacagggtgctcgctgggaaggagcaactctgcaagttcctgctttgtctcccctgctttccctactgtccacacctccaaccttatctggggggctcctagctccacgtgcataccatcagtcctcagtcaggtctcagggggccagtcctctttccaaaggccattgccaatgcagccttcatctgcaaagaggacaagtccatgttctcccactgaaccacagtcttgcagtaacaaattcactttggagtcatggaccagcctctgctcccaagtagatctcaagcctcacaggccagtggggtcggggttagagggcctgaggggaactcagaagggcaggggcttgtctggggagtggaggcagtttcgcggaggaagtggtcttggaactgaggagaacattgccagttggagtgaggccaggaatgttcatgaatttttaagggaaagggaatggagtgtgcaaaggcccagaggcatgcaagggcctcgtatgtacagaaaagcaggaagtaattcaagatgtctgaaatttgggctaagtagaagaggaaagaaggatagcataggcagatgagatggcatagataattaatgagcagatagggaagaaaatgccaaaagcaggtctacaagtcttcccacgaggaaggagagccattgaggggttttgtagaggagcagcaaggccaggtgtgtgaattcaaaggcccacggcccccacccccaggcatgttgaaggtggacctattagaacaggtagagactagagcctgcttcagtagctcaggtgagagaggaggaagggctgaactgtgggtggagaggtcatcaatttggggacactctttctggcaagcctcacagccaacaggcctcatctgtatgatgcaagaggtgaaggagaccacagtcgctggaggcacccgcccttctctagcttggtcatgtgaggagatcctacaaggcaaggcttccccaggccgtgggaccttcgccatgagttcacctgctgacatcttcccttttagcctctttctcacccgaacagcccactgcaagagcagaataaaaagcctgggccctactttcccacacaaacacaccacccccaccccccatcaggagagttgctgaggcgaggggccccgctctaccccatgtgtggcaggcaggaaggggagaggggacacagggagcaggtcagggcctgctctctgtcaaaggaaatatccaccctcctaagcctttaagaaactgttttcttccaagtaggtcccgctgttaccagggcaaccgagagccctggtatttgtgtttctgtctttggagtccctggggagaagtggcctgccgagctttccctagtctgggcaggatacaggaagtgctggccggaggtggagcccactccccacctcccattaagggggtggtctcttgcctgattaatgcctgtccttatcccctggaagagtccacccccaccctcaggagccacttctggcggtcaagggcacaggctttggctcctatggacctggtttctcgggggcagaattctgcacctaccttgtggcacatctctctcaaatgggtgtcacctgctgtctgaggcaggtatccaggaggggcaagctcacatcagaccatggtacctgctgagggatcgtcacgcatgctatgtttcttgatcacttactttgtgctagaactggatctgtgggtcggttcttgctccagggagctctaggggaaggctcagaaccaaactggccattaaatgtcacacgggctagttagttcccaaagctctatgctgctctaggctgggctgtgttggatgttagaattgcctagggagctttctagatgtagacattcctggagattttgtttccaacggcgtgggtgcaggtggggagtagaggttaagagcatgggctctggatgtcaaactgctggggttcacagtcaaactcggcaaacagggcaagtgacctcaagccacttgcctgattggtttcctcacttacagaatgaacgtggggaagtcacagctgtttcacaggcagcaagattttccttgccttcctccatcgctcagcccaggagagggtttttaggaccctcgccatccttgtcacccttctactgtcttccttccttccttccttccttttattctgatgttttcttactcctggcaagccaaagggcttctgtgaggtgcaactttgtccccttccacagggcagccagggccccaggtgggccctgcccatctcaaggatttcacattgctattgcagcagcccaggaaagcattggcgcatctgacagccaggtcagtctgtgattctgaccgatctcctgtcaattcacatcctcagattttcattttcacaagcttcttctaagccacatctcccccacttaggcttctgcagttgcttttctgaacctgactgcaggatctcagatgagcccctagtaaaggtcatttcagtgcatccttccaggttagggagagttttttggcccctcattcccttttagaggacattagaggacatcttctagtcctccaagctttgtaccacctgcagatgcccttagcaggctgcctctaggtctccatccagtggcccatttattcactcacttcttcatttatgtaccaaactaggattgagattctactgtgtaccaagtagtgtgctgggccccagggactcaacagtgactagacagatcaagaagccatggcccgagaggggatgagactcatgccagagcccatatagagtcagcagcaaggctggactggaatccagggttcttttccccattcccacagtgcttcctgcttcagggttggggcaaggctgactctgtttgtctttttttccaccttctctggccataacacaatctgggctcacctatcactacttgtgatgtcataagaaatcccctgggtgctggagaccttgtcaggcaccctgaagagtactggggagtcctagtgctcactgatgaagcccacgaccccataaccctgttcctccctagaaggggcagtcaaccacatacttagaactgccacctggctggttcccccagagcttccagagatggtgcacctgatgcgtgcttcgttgctttggcaaagacccagaatccaggcaggttgagacttcaagcttgtcaggagtctctcctgggagatagcaagcacggtgtatttgagttaagaatgtatatgggtttgggagtcacgaagacctggagtcccccatatgacctaatatctctgagattcaggtccctcagctctaaaaggagacagcatcacctgcctcacttaattgtggagatgaaatgatgttggcgaaagtccctggcacatggtcagaaataccatggtttcctccctccctcccttcctcttaaagggacaaagcaaatgtgcctctgaaaccagggtttgtttcccccacgggaatcctgcaagctggaggcagggggggtaggacagggcagaactaggagaccagcctggcctgttagacagcagggccagcggagtgggggcagagaggtgctaagtgtccccagagctaatgggcagctgcagggctgtgacagagccactcactagctgtcaaccttgggccagtgacttctctctaagcctcagtgtcctcatctttaagatgagggtaagggtagttagttctttccccccaggatatcattatcagaatgaaataagataacagatgtgaagtgcctggcacagcactcaaaagcagcagaggcttaatgaatgttcccacccacttcccctggaaaaaaaaaaaagtccaattcatgctgggaaacttgggcaaatcccagaatgggattcagtttcttctgaccccacagtccgtgaggagccatgagatcttgcttggagggcctcttacatggactgctctggggacttgtgattcatcaccagctaactcactggtatcccatagcgccacctagtgccaaaaagcggaagggccctccccagccaacctggcctctttctcttccttcactcaaagtcccatgcatgcccgtgcgtgcctgtagggctgggccacccatagtccccgggagaacgaatgctatttttcaagatgcccagtgcttccacttccctcccaacaatttcttccatccacaaatgcacagaactgtagacaggtcccttgagcctcaccggcccttggtttccttgtctaaggatttcaagacttcagggtagggttgactccggcaggggaccttggaagtaccctatgcctactctgtacccatctatgcttgctcaataacaaagaggcacaatctttacacaccctttatatttttattgaggagagaaagctttagcatacagagcagcttcttatcttcacaacacagtaatgcaacaataacacatgtattccaaaagggtttcctcccgagcctctgggagaccttgggctgccttcatacccctgcatgcatcccctccccccacccctctttcaacccaagaaagctcccaaagcccacagttcctcttacagctcttatggctgttacatcacaacaaatattgaagatctgggaaaggaaggaagagggtcaaagggaagcccaagcccctcctgccccagagggtggaaaccagctcactgctcatctgctctatccctggctgtagctctgagggttcagggtgagaagcaccatgggaacaggcaggacctgtgctgaagggtccctggaagtgtgggtttaaggcacccgtccttcacacttctccacagggacatggggcagcagggccagagtgttgaccatcagcaaacagggtccactgcctcgaagaatagcaggtcccctcgaagaatagcaggtccccttctggaatgcactcttgaggaaatcagataaaatcagctgaaaaacagacaaaattttctttacaaagttgtttactcctgccctggtggggatggggaaaaccagacaattgaaaggtccaacaaattaggagaatgcttaaatgaattattcagtatgcatgactgcacaggtggcagccattttaaatcctgctgatcaagaactggcagggtgatctcagctttgacaagacatagcaagaacacactagaaaggaaagcagcaaagtgttaatagtgcttgcctctgtgtggtgggactctgaatggctggggggtttttgtcctcatagttttctctattttccaaactttctttaatgattatgtattacttttctctttggagagaggggatctttttaaaaggtagcaacaggttataggaatccaaatccactgatccccaggctgagaaacaaaagcgctaatgaaaagggcatcttacctcccactgatgaatagagacctcaccagaaaccagtcagaggactgggtttctctgcgactcctcttcctccagcttttttctcttgcctccaggcccaagatcctaaggtccgcctgagattatcggtcagactcccatgaggaacagaggttgaatttactatgctttcttccctttggccacaaaccctggctgcacttgctctgctgccagtcactgtgcagaaagtccagtgtccaggggcagttcaggccagcagtggatttggctggcattttatggccaaaactgacatagtaagtgtgtgtttttcactgcagaagcagtgctttctggactcaaggcaagcagtgggtctctttataagggcacctgagtttgtacctagaagtcccaggagttcctaggaggcagccaccctcttaagctttactgtgtcactgaagcacagcagcaggccaggggttggcccccatgaggggtcccagctgtgaggccacggtaggtgcagccttcctctctcctctcagaactaagggttccttgaaattgaagggagctcagagcaggccatgggccctctctctgtctgtcccagaaggaatggccaatcaggcctcctctgcaactccaaggatagaaagtgtcctgcaaagacctttgactgggggctgcagtccaaggcctggcaaggggagaagaccaccatccctaaggaaagagtcactctttacaatggcagaatgatcgttgctgcttctttctcctcctcctcttcttcctccttctcctctccggaaccctaactggctaccctttaggcaacatcaaggaaagttgtggagcctgcaatgttgggcgctgtccaccgggggtgcccaggagggcaatgtggtgagaggaaagggctccagatgtgtggcaagtcagtccaagagccctgatacaggaatctgtgcaaaggtaaactcaagtgctgtaagtggaaccagcctgcacagtcagtcaagggcaaatctccgtcaagttgtccatttgacatgtggctttgcacactctcactgggctagatgtcgggtcctcttccaggccctctgctggaggtgtggcatgaaatgagtgtaggattctagggacatttctggataccatcctgctcaccatcgattatatctagcaactggcctcagtggctttaggagttcagggtagcctgtcctcttgctcattggggcagatcagtgaggcattgggtgaagtcctggtgggtcagtcagagaataaaactgtagaacatagggtgaagaaacgcaggagaggtgagggttaggaacaaccagaggggaaatacaagagggtgaccagttcatttatgggaacaggcccagaaacttgctctccagctcgtggccggactgagcagagtacatgccaagagggcagctattgctgatccctcctttcccaggtggccctggttgggcacacgtcgctctctggtcacggttgcaagatggtctggaattctgcaggtcttcttcaggttctgcaggtctgaaactccctgaagtcctggtcagcaaatggggcaggtatggcagcaatagcaggggcgggggatgcaaaagaagggtgtgttctgggtggccatctggccccagcactcaaactcgaattcggccacgagcagctcggtggcccccctgtctcggagtgaggcggaaaagcacaggggggcgtcttcgaacttggcgttgtcctaaacgacctgtgcggcgaatcagttggggggagctgtagaatggtgaattggtgcctggaaggccttccagaagtgggactcgattctggttcctccgtctgctaggctgtattatgggaggtgatgcacccaggaagttttcggcgtggtaaccacttgtggggccagaagtctgggatgacgcgtgaacaaaggtcggctccatctccatcagctcatctaggtcatcatcttgggcctcatccagtggctcctcctccacctcaccataggtctcctcagtccctggatcctgctgtggctctccttctggtttctggcccccatcctcatcttcatcttcttcatccttactctctccttcctcctcattcttgttccttatctcctcctcctcctctttctgtttcatttcctcttcctcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgtgttcagataacaaaggacttgccacacagaaaaagagtcgatgtgctctgtgttgctaccatggcagaattaggaccagtgggtggaaacccagaaggaggcacattccacctccagataaggaagaactttctgacacacctgacagccccaactgtccgtggaagaaatgagctgccttgggagggagggagctccccttccctgcaggtgtgtgcgctgaggctgaagaaacacctagaagggctgctgaggagggagtctgggcacagaatgaggcgttggaccaaagaaccccaagagcaaccccaaatctctgtgattctgagtctttgttcagtgtacatacagcatgaatgtcccttctctactctcactttcttcatgtattctcatcaaattcatcacttcaatcaaccctattcaaatcttgtgcatccttactcactgatgatgccgctgaacttctgcctcttttatgctgttacctcctccttccctctccttcaccttagccctcctagacctgacatcacttacagcgggactaaggtgcagggaacacggcccacaaaggctcaagtaaaagttcttgacatccaagaaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttcgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccacccccaacccaaggccccagtctgccaggcgtctggagtttatattgatggtgagttgcctcatcccccacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccatcaccttctctcccaacagcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtagagttgcttagcaccgcctttgtcttcttcccttcatgcctctacagaccatcctctttgatgcactgggtattgggggagggaagtgagactttctttgctaccggctcaccttgcgctgtcacggtcatggctcttgccagggaacggaggcatgcagaagagggggcgctggctgctctttcttcaccccctcctggcactgccaccctaactgagaccatttgatagcaagcaaaattttcttaacagaaagctccaaagccttatgaacttctgtgctcttcagagcacttatggaaacttaaagtttgtgagttctgtttgggtcagggcaagacaacttcttgtgcccagagctgggtttggagtacactgataagagtcggagcaggagagtggggtttggagtgctggtggtaacaagggaggagtacacctgggcacagaccaaaggcctggtagcactttcactggacactagtcttctagcaaggtgggcttcttcaacttgtttggcaagttttcaagaaaagaagtggtagaaaggtcctaaggccaaaaagaccaaaaggggacccagtacaattttaagagtggggaacgtgctgtattatatgtagcccagctggctgtggctctgggggcatgtggcacactataccatgctcactattaatccatgatctacactccatcagctgtaaggggaagagaaggagggccagtcatttgagaaggagatagggccagcgacatgatgaaaccatgatctcagtaacctaaagggatcagaggggtcctgtgagccagcgccagcctgtgctctgctgggaaatgttgatgaagatgatgaggacagctctggccacatgtggcaatgctccctggatatggggtcctccactgtcactggcatcatttcagaaaatcagaggcaggaaatacagcccacagcctagggaaatataccaaaaggagtgagggctgatgaggaaagactccagaagtgatgttgaacattttgtgtctaaatgtctatcttggccaggcacagtggctcacgcctgtaattccagcactttgggaggctgaggtgggtggatcctttgagctcaggaattcaagaccagcttgggcaacatggtgaaaccccatctctaccaaaaatacaaaaaaatagccaggcgtggtggcgcacacctgtggccctagctactcgggaggctgagatgtgaggattgcttgaccccaggagtcagagattgcagtgagccgagatcacaccactgcactccagcctgggtgacagtgagactttgtctctaaataaataaataaatgtctgtcttcctctcaatgaggctgtccctgagcattgcccacagagccacttgctgaggtgtctgtgaacgtgtgcagctgtgtggctggctgaatgagagaaagggagggggaatcacagacctcgccccaccaccctgccttgccttgactctgacccagccatttcccagcacccaaagactgacctagcactttaagagaaatacagctctaaaaaatttttttaataatattaagtaaggcatattattgaggaaatattccattttaattgtgttgaatttgaaaacattatcaagtcagtaaacaaactgaattaacagatattttgaaagtaccatgtaactcagatgaagtgataactataatctgtgtcaataattttcctaaattgaaaagccagtgccaggaaaaaaagagagagagagaaagagaaagaaatagagctcaatcaccatgctgtgagccagctttggtaaaatgtgaccaggtgactgtaggacagactatcaggcatcttcctggatggtggagggcagtagggcagcctcttggagacactggcctcacctggcccatataaaggccttctctgagaaaagatcacagtcaagcagcatctagtcccagtccgctgctctacaccagtggttctcacccctggctgtacctctgaataatcacttgaagacttctagaaaatgcttctacctgagccctactcccagagatttcagtgttctggggtaaggtccaggtgttgcagtttcaaaagctgcccagttgagtttaatatgtagcccagggttgaaaaccactgccccaggccacctaaaacttacaggcaacctgggtgcagcctgggaaacccagcatgcattcccagggccaagttgggaaggatgaggaagaagtgccacctgccttggatgctattcatgcttatcacgactgccatcattctcttctctcaggccaatttccaccgtgctttaaacagaaaccaggatgcacccaagtgtctttattttggctacagggcagcagtttgataaacatgcaagtttgcgacactcgttgtttaacacagagacagccgtgaaccccaagtccaccctgaggcggaggcggaccattattggattctctaacttttcccagcgagaccaaggtgaccccaccacagctgattccccagtcccttccccttacccactcctgccaatcctgccacccaggtggtactgtggtgatggggaacaggaataattgggtggaggagggggcctccggatgtcctgaaaaagccaatatggtaattaagaatagctaagggcctcttgtcaagggtggcaactgaatatggagagtaggtcttccgggctaatgaatccattacattattgtttcccattataaatgtaatacaaccagatatgccaaatttaggcaaatagatgaagagagagggttcctcaccatcatcttaacagaaccattactaccattaagtgaatgctggccaggagcacagaccagggagatagcagagggtaagagccctggtctttccgcttactaaccaggagaccttggccaagtgacataacctctctgagcctcagcttcttcatctataaagtggggataatgatactgacatggtggaattagcatgaagattagcgttattgtatgtaacttgcctaccatgtgcctggtacatagtcagtgtccaataaatggtggctattgttacaaattctcatagcagtagtagttataataataataataatgacatgacagtattaattgtttgtgtgtatgagaaaacctttggggatttggaacatccaaacggtttcctcacatccgtagattatcctcagcctcttatgttgcaaagcctaaaagtgatgggtgcgaacaatgcaaccagactcttagctttgcatcttgggcatgctccagagtcattgctggagccaaacgtcacaccatgccgtccttagttcggaagcctctactctcatctctagatggatgaatgctgaggtctgtgatggtttcatgagcctggggtgaaagtatggggaaaatgcaaggtaatcccacgtgacacttcagctctaagaggaataatcaaagctggaaagtatttggcagccatctggaccattcaagggcaccgtatgtctcactgtggggtgatgggcaaggacccaatttccccagcatcttcatccatggaagggaagaaccaaggaattctgaccaagctgttggcaaatgcttcttggcaaaaagttggtgctcctgtctcaaaacagctggtgggagatcccttgctgtagcactcatgtcctgtgtttatttcctccaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcctctttttgtgccttccggaggaaagggagctcactttcttgggtggtttgagttctttggctcttcctggaaccataaacataatacataatgcttctcatcctttctttttctgtctctttttgttttaattgtggtaaagtacccataacatttaccatcttgaccatttttaagtgtgcagttcattcgtgttaagcacattcacattgttaagcaaccaatctcccgaactcctttcatcttgcaaaactgaaactctgtacccagtaaacaacaactcctccttctccctccccgcagattcctccctccaaccaccattctactttctgtctctatgaatttgactctagacacctcatataagtggaatcatacagtatttgtctttttgtgactggcttattccactaagcttaatgttgtcagggttcatccatgtttctcattcttttctgaacccttaacaccaaaaatcaaaatctcatggccttctatatgcaaatttggactttcaatatgagtcaattatgactaagtcaagtaaataaatcaaagccccaggtagttgtagaaaacacttcctcagactccacaggctcccctctgagattcaaataggttccactctcacccactgggtgggagtcactagtttagatcactcccagctccttcatttggagaaatgatatacagtgtttaaaacaagagaatgctcgggccacctgttataatgacaaagacatgacagaatagggacccacgctgatcttcaccactcactccaccttgggcaaatcattaagcttctgaacttcatattcctcctctgcaaaatggaggtattaaaaatctccaccctgctgccctcacagagttgctttcaccatcaaatgaaataacatatgagaatgtgctttgtcctatctactgtggtcaaagtcattccttttggttttttatgtctagggagttctgtggaaccaggcaccgaagaaaaaagtttaatcagtgataaaacagctgaatggattgcagaggatgatgatgacgtgtttgtggcttcacgcacaactgaagatttatttactgtgatacacaggtctgcaccaatttccttaattctaattgcaattgccttccctttttgtacttaaagaaaacctgctattccacattgaaatcctaattgtaaaagaaaaagaaaaaaattaaaaataagaaaaactgctacctttaagcagccattagaattgcacctggaggctaagttcagatacccacatatgtgagcgcagtccagggcctcgcatctcaaattcactgacatcgttgggtaaagtggaggaagggaggggagaggaggaccaggtgccgagtgagaggcccctcgtctcctagcaaccacttggcctattgtggctccatctgctctctcttagctctgtctatagtcagagacatttaacccttcacagaattccttgtatcaaaaaaatcccatcaagagttgaagtggggcaccaggcagcatatcaaaacaggaacttaggaaaagaggaaccagatggggaccagttattggacagggttacaaggcaggggttcagtgacaagaaaactgggaagagtttattattggagctagaccaccagtccagaacaggatcagtccccaggctgtcctgattcagagtcactgagctactagccttgactcctgaaattcgtccttggtcccagaacctgggcaggactgaggctacaggcacaggacaagtgactccagctgggggcattgaaaggaatatggggacgggagggcccaacaagggactctgaggatttagaggtgagagagagagaaagcaggtcaatacggctgcttgcagggctgccgcctggattgtgtcacaggcatgggggtctgtgaagcactggtaaatgtctgctgcattaactcactcagaccaaactttctcttatctaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaa

SEQ ID NO: 3488 - DNA, 232486 bp, human; identical to SEQ ID NO: 3487

SEQ ID NO: 3489 - DNA, 232486 bp, human; identical to SEQ ID NO: 3487

SEQ ID NO: 3490 - DNA, 4791 bp, human
ccgcagtccgctccctcccgctccgctcgcccctgcccgcccgcccgcccggtcgcgcggtcgccgccgccaccgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggaggtaagatgcccttttcattagcgcttttgtttctcagcctggggatcagtggatttggattcctataacctgttgctaccttttaaaaagatcccctctctccaaagagaaaagtaatacataatcattaaagaaagtttggaaaatagagaaaactatgaggacaaaaaccccccagccattcagagtcccaccacacagaggcaagcactattaacactttgctgctttcctttctagtgtgttcttgctatgtcttgtcaaagctgagatcaccctgccagttcttgatcagcaggatttaaaatggctgccacctgtgcagtcatgcatactgaataattcatttaagcattctcctaatttgttggacctttcaattgtctggttttccccatccccaccagggcaggagtaaacaactttgtaaagaaaattttgtctgtttttcagctgattttatctgatttcctcaagagtgcattccagaaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaa

SEQ ID NO: 3491 - DNA, 4800 bp, human
gatcctgccgcagtccgctccctcccgctccgctcgcccctgcccgcccgcccgcccggtcgcgcggtcgccgccgccaccgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggaggtaagatgcccttttcattagcgcttttgtttctcagcctggggatcagtggatttggattcctataacctgttgctaccttttaaaaagatcccctctctccaaagagaaaagtaatacataatcattaaagaaagtttggaaaatagagaaaactatgaggacaaaaaccccccagccattcagagtcccaccacacagaggcaagcactattaacactttgctgctttcctttctagtgtgttcttgctatgtcttgtcaaagctgagatcaccctgccagttcttgatcagcaggatttaaaatggctgccacctgtgcagtcatgcatactgaataattcatttaagcattctcctaatttgttggacctttcaattgtctggttttccccatccccaccagggcaggagtaaacaactttgtaaagaaaattttgtctgtttttcagctgattttatctgatttcctcaagagtgcattccagaaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaaag

SEQ ID NO: 3492 - DNA, 2556 bp, human
acgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgtgttcagataacaaaggacttgccacacagaaaaagagtcgatgtgctctgtgttgctaccatggcagaattaggaccagtgggtggaaacccagaaggaggcacattccacctccagataaggaagaactttctgacacacctgacagccccaactgtccgtggaagaaatgagctgccttgggagggagggagctccccttccctgcaggtgtgtgcgctgaggctgaagaaacacctagaagggctgctgaggagggagtctgggcacagaatgaggcgttggaccaaagaaccccaagagcaaccccaaatctctgtgattctgagtctttgttcagtgtacatacagcatgaatgtcccttctctactctcactttcttcatgtattctcatcaaattcatcacttcaatcaaccctattcaaatcttgtgcatccttactcactgatgatgccgctgaacttctgcctcttttatgctgttacctcctccttccctctccttcaccttagccctcctagacctgacatcacttacagcgggactaaggtgcagggaacacggcccacaaaggctcaagtaaaagttcttgacatccaagaaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttcgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccacccccaacccaaggccccagtctgccaggcgtctggagtttatattgatggtgagttgcctcatcccccacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccatcaccttctctcccaacagcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggt

SEQ ID NO: 3493 - DNA, 232486 bp, human; identical to SEQ ID NO: 3487

SEQ ID NO: 3494 - DNA, 121161 bp, human
ttcaacaacaagcttccaagatgccgcccaaaggaaaaagtggttctggaaaagcggggaaaggtagagcggccagagcgatcaaggagaatgggggcgggtgaggagcgaagggagggaacagacagtccatctccggagtccgggacggacgcagcaggtagccagtggccccacagtgctgccatcgattacatctgtaggaatacattgggctacggttcagggaccgtcctagtgggtaatggaatctgatggggatagttcctcggaggcgatgacttagggctgctatttcaaggggttattagagctctaaaattgggtcttatcaaaagccagcaataggaagtacacattggttatggtccttaaagttcactttaatgcttacagaatgacatgcccaccatcggggaaggaatcattcatccattgaacagaaatgtgtcaggcagagtgctaagcgctgaggatacacaaataagacagaaggctgggcgcggtggctcacgcctataatcccagcactttgggaggccgagggaggatggatcacgaggtcaggagttcgagaccagcttggccaacatggcgaaaccccgtctctactaaaaatacaaaaattcgccaggcgtggtggtggtgcgcgcccgtaatcccagctactcgggaggctgaggcaggagaatcgcttgaactcgggaggcagaggttgcaatgaaccgagatcgcgccactgcactccagcctgggcgacagagcgagcctctgtctcaaaaaaaaaaaagagattttggccttaaggagctcccgaagtagtgaggaagataaaggcttagtgatcataaagcactgtactaaatgtagtgttgagggatgtgtatgggatataatagaaattgagggaagtccttcatttagctggggaacagggaacggaagacttcctggagatgaattaggcaggtcaagatgtgcattgagggtaggttaaagcattccttacttggggtccagcagcaaaagcactgaggtgagaaacagcatgatgtgtgcagcgtagtgttgctggagcaaaaactcaaggcagaatggcaagtggtgagaatgaaaacagaaacaaagacgagatcatggagagtgctatatattctgctaagaaggacagttaaggatcagaaagacctgtaaggagattgttgtggtagtcttggtgagagatgatggtggactgacctaagggagtggctgtgggaactgagaaaagagaaaagattctgtaaatattaggatgtgaaatagtcaagacttggtgatttattgggttggggaggggtggtgagggaggatcaacgatcattctgttttctggattggatttctaacctgttgctggtcctgcagggtaacatcaaggatacatgaggagcggggatgagattgatgaattcactttcagatagattggctttgaggtgtctgtgggacatctcagtggagatgtagtcaggaagtggttggatatttgagtctaaagtttgagggagaggtctagactgtacatgtaagttttaggagtcgctaacttatagatggtagttgagcccattagagtgtatgcaattatccatggagagtttatagaatgaaaagagcagagagcagaggatgtgatcctaggacaggcagagaaagaggcagacagatagagggagtgcagaatggtggccagaggctggagagaccagaatgttttaaagagagagggtatagtctatcaagaacagcagatttggaaattagaggtggccttgggtaaaagtggtttcagtgaaacagaagccagattaccgtgactagagaactgactgggaagtggtaatttggacttcttggaaagttttaattgaaaagcatggaaatgggatggtagatagagaaggacagaggattaagagaaagttttattttctttgcttctttggaatggggaaaacttgggagtgaagctgaaggatccagtaaagtaaaagaggtaaaggtacagaagagtgagatttaggagaaaatggaatccaggacctagggggagcagggacaccttatgcttgaggtcataggaaaggagatggaggggcagggactcagtaggcatcttgaggagagtggtaaaggtctggaatatcgtaatggaagagggaatgaaacacaaaagaagtgccttcagggctaggagcctgactaagatcaaaggccatgaatttgtagactacataatcttcacagtctgatttacctagtactatgcaattggcacaatataggattgaaaagagctaggtgcagccttaagccatggttgaggttttgttaggcagttatgataggaggatagcaacaccagggaattacaagggccagtgggaatgcagttcagatgaaggaacatggggtccagagtgggaagggaaaaagaagtctggtggcctaggtgaatgtagcaggacgaagggactggggtcaagggagaggttctgtgaagttaaagagcaagtattgtgggaatgagacatgaggaagctggaagaacaggaggttatagccagagactgaactagttctgagtggcacagttccatcgtgtgcccccggggcaggtagcttggagtagagagcatgacattcgggaaagagacctagaactgagattccccaagatagatggtgaggtcactcaaggtaatggcaggagtgagggtggagaggaagcccaaagctgatgccagagtcgtcaggaaatcaaaggcagtgaggtggcagtcagaagatgacagcatccagcagggaagaggatgggataactggaaggcatcatcattcaagaatggatctatagcaaacccagttaggagtttgatttaataacactcctttggcagtaacatttttttagggttttggtagtcagtatttggggttttcagtttaatcaaacatttattaaaacaccttttgtgtgccaggcattgtgctaggcttggagatactaagacaagcaagatggagactcttgcttaaaacttttcaatggcggccaggcgcggtggctcacgcctgtaatcccagcactttgggaggccgaggctcgcagatcacgaggtcaggagatcgagaccatcctggctaacagggtgaaaccctgtctctactaaaaatacaaaaaaaattagcggggcgtggtggcaggcgcctgtagtcccagctactcgggaggctgaggcaggagaatggcatgaacccgggaggcggagcttgcagtgagccgaaatcgcgccactgcactccagcctgggcgacagacagagcgagactccgtctcaaaaaaaaaaaaaaaaaaacaacttttcaatggctccctattacgtctaggataagtcccaagctccttaatggggccaaaaggcctcaatgccctgaccctcagctacctccctcaggcaggctcatctgagtgcactcccacctcagatttggcttcatccatacaatttcttacacataccatgtcgtttcccccattctggagtgtctcctcatcctttctttggctaaccagctcctactcatccaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaactgagcccttaattcaactgtaattcttaggaacatcagcctctagcagtatgtaggctgccattgacacagaagttaccatagtagtaaaatgacatactagtaaaatgtaagatgctgctaatggttctaggaagacatcaataggcaatgtagtagactctagaaatttggacatgaatgtattctttagccaaaaatgggtagtgggaaatttgatctttttaaaaaatgtattcttagagattttacttactggaattgtgatgcttgaacacatagttgtggtacatgatagaactcttacaagaacttaggagtctgccctcagaaggcagggtgttaaattggatgcaaagaatctgggccaggcttccggagctttcattcacctattagcacactcatttgtgtatccattttctgtgaagggtttatatagggcacagatttcctgtttgaagaaagatgggtcagattaatttagcttgatgttgtaaagcaagcttgtccaacccacggcccacgggctgcatacggcccaggatggctttgaatgcagcccaacacaaatttgcaaactttcttaaaacattatgagatttttatttgtgattttttttttttttagcttgtcaactatcattagtgttagcgtattttgtgtggcccaagataattcttccattgtggcccagggaagctgaaaggttggatacccttgttgtaaagtgtctggccgagttcccttttgaagtgtggcgttatgatggaaatatccactccggttgtgtgttggacctttctgtaaacatggaggtgcagtttaaatgagtacctgtcatctcttctctaaagggggagcagcctctgggagtgacagtgctgacaagaaggctcaaggtcccaaaggtggtggcaatgcagtaaaggtgagttactggttcctttttttccatgttaaatataaattctgtttatgtgttagtacacataaaagacagaatgcttaactcattctaacaggctagcctaacactggtataaaatcaaaataacacaaaattgtagctgggcgcacctgtaatcccagcactttgggaggccaaggcaggcagatcagcctggccaaaatggtgaaaccctgtctctactaaaaatacaaaaatttgcctggtgtggtggtgtacacttgtaatcctagctacttgggaggctgaggcacgagaatcaagaatcgcttgaaccaggaggctgaggttgcaatgagctgagattgcaccactgcactccagcctgggcaacagagtaagattccatctcaaaaaaataaataaataaaaataaattttaaaaaaatggaaaatatagaccagtcttgcttatgaaaagtaattccctttaaatattttgtcatgtactttctcagatacccagaatttctttatagttttttagtattgttccttaaaatgcattaagttagatcttcccagtaattgagttatttcttaggacaaaataatattttataaaaccaagagattagataagtgttaaaagtcctctgctgaataaacaggcaagggtgcaggtctctttagaaagcttccccactggtgagccacaaaccagggtcttgaccatgaaaatgggggcaggagaaaatcagcaaataattacttgaaatacttaacctagccccagaggagtatctgctgggagaaaatttaatctgcaaactagtaagtgctatgtaacaaggcaatttccatgttttagtcaggatatgggaggctgtactttgattcattcattcagtaaggacttagtgacatctgccctgtgccaagcaatgtattaggctctggggattttttatcatgtatttatttaataaaaaagtaagagatgggccaggcacaatggttcattcctgtaatcccagcactttgggaggccaaggcacgaggatcacttgagcccaggagtttgagaccagcctgggcaatatagcaagaccctgtcactaaaaaagtaaaaataaaaaatcagccagacgtggtggtgcacaactgtggccctagctactcaggaggctgaggtgggaggatcgcttgagcccgagaatttgaggctacagtgagccatgattgtgccactacactcatcctatgcaacagagcgagaccctgtctcaaaaaaataaataaaaagtaagagatggtccttgttatcacaggctacttgggagcagttaggtaaagatatgtatttcattgctgtatgataagcatagcagtggaactgcatcatataaattcagccatacatgtgtagcctaaaaaagagagatcatgtaaatggtgtggactgttctgcccactcttctattcaatgaacctatgccccacagagagagagagagatgagagacatgcacctgcttttctatagttgccctgaattcttgtgtgagcatccaatcatgtgaagtggggttctggtatccaaagataagttttcataaaacatagcccctaaatacaacccagttacttcatgttacaaacggagtacagcgttcctggctatgtctgggcttaaatgagagctgacatgctggtctcccatatgacatcttcataaagggatattctagggtaattttggctatatgcagttttcacctaatatgttttcacaagcatctaacctaagagactgttgcactgcatatggctttagctacttttttttatttttttttttgagacggagtttcactcttgttgtccaggctggagtgcaatggcacgatctcggctcactgcgacctccgcctcccaggttcaagcgattgtcctgcctcagcctcccaagtatctgggatcacaggtgcccgccaccgcgcccagctagttttttgtatttttagtagagatgaggtttcaccatgttggccaggctggtcttgaactcctgacctcaggtgatccatctgcctcggcctcccaaagtgctgggattacaggcatgagccaccgtgcctggcggctttagctaattttttaaaaactttgttttgttgtttttatctttgtagagatggagtctcgctatgttgcccaggctggtcttgaactcctggcctcaagcgatcctcccgcctcagcctccaacagtgttaagattataggggcatgagccaccacacctggtgcatgtggctttaaagaggcaccttaccctctctggaaaaaaaataagttcaatgtggccactcatgagatatatggaaaggagtggcacgttattcactaggaaagtagattagggttaaatttgtttttataaagccttttattttgagataattatagattcacatgcagttttaagaaataatacatctagctgggcatggtcgtgtgtgcctgtagtcccagctacttgggaggctgaggtaggaggattgtttgagcccaggagtttgaggcggcagtgagtcaggatcacgccactgcactccaacctgggcaacagaatgagaccttgtctctaaaaaagaaaaaaagaaaaaggaaaagaaataatacgtattcctttgtttctcccaatggtaacacctaacaaaactatagtacaatagcacaaacaggatattgacattgatgtagtcaagatacagacaatcctaccactacaaggatccctcctcttggccttttataactatacccgcttccctcctgccccacctctgccctcttaacccatggcagcaacttatctgttctccatttgtgtaactttataatgtcaagaatgttatatgaatggaataatacagtatgtaaccttttgggattggttttattcacccagtataattcgctggagatttcattcaggtggttttgtttatcaatagtttattcctctgtattgctaaatagtaccagttgagtatccctaatccaaaaatacaaaatacaaaatgctgtaagatctgaaactttttgagcgctgacatgacactcaaagtaaatgctcattatagcatttcagattttgaattttcagattagggatgctcaactggtaagtttaatgcaaatattcccaaatccgaaacactctggtcccaagcattttggataaatgatattcaacctgtatcccatgatgtggaagtgctgtagtatgtcgaaccattcacctgttgaaggacagctgggttgtttcaagtgttttttgaaggcaccagtcggtgagggaccctgggaccctctggccttttagggttcagctcctttcacattctgtcattctgcttcagaccccacccctgtgcccacaccctgcccttttgtcgctataagctctgcagattctgagacccatccactgaccacagcttccctccttccccttcccttcctgcctccgccaatcctgttcctctgttcttctcctcacagacccccaagccctcaagcccaccctaatctccccactttctcctaggcttcatgtttgttttcctatcccctgcacactcaaaattaggcctaagggcttgatcattggattgaggaggtccagtttttcttttggccacctccctgcatccacctccctgctactcaggatcaatccaatggtctactttctatgcacttaaaattagatctatagttagaagagaagaattcgagtggttctagtataaagaaaagacaaatatttaaggtgatggatattccaagtatactgatttgatctttaccaattatatgaatgtattagattattgcattaccttgaaactgtacatctactatgcatcaataaaaaagaaaggaaggaaaagaaaagaaaagaaaagatttccttgaaaacgtctagctgggggcaacttaaatattaatacttgatttttaataagtatgtaaataaagtatttactaataattccaatatgagtattatatttgcttatagatgaacttatttcagtagcttggctcaaatttgaaacagttacttaagaaagaaaaattcagccgggcgccggtggctcatgcctgtactcctggcactttgggaggccaaggcttgcggatcacctgaggtcaagagtccaagatcagcctggccaacatggtaaaaccccgtctctgctaaaaatacaaaaattagtcgggtgtggtggcgggtgcctataatcccagctactcgggaggctgaggcaggagaatcacttgaacctgggagacagaggtagcagtgagccgtgatcacaccactgcactccagcctgggcaacagagcgagactccatctcaaaaaaaaaaaaaaaagctccccagaactgctgggccctactggaaagtcacacagccttggggattgggactactaatacttggtctctgactttacctaggccctcagtgctgctcagcaatcctttaccgcccacctgtagccatccaccaccccactcccatcagtcaacagagaacttcattccatggttctcaaccctagacgtacatcagattcgcctaaaaaaatacgagtgcctagggtctcatcccagaccaactgcatcagaatctcttggaggggggcctggactttgataacttttttagaagggctgggctctgtggctcatgcttgtaatcctagcactttgggagcccgaggtgggtgtatcacttgaggtcaggaattcgagaccagcctggccaacatggtgacaccttgtctctactgaaaatacaaaaattagttgggcatggtggcatgcgcctggaatctcagctactcgggaggctgaggcaggagaatcacttggacccgagaggcggaggttgcagtgagctgagattgcgccactgcactccagcctgggcgacagagtgagactccatctcaaaaaacaaaaacgaaaaacttttctagaatttctggaggtgattctaatatgctgccagggttaagaaacactcatctagtctcacagcgttagtgtgaggatttaatgagataagtactcatcaacttttaaatgtttttattattttaacaagaaagtggaaaccagacccattgtcaggaactcattggctttcagccccctagcaacaaagttacctcctcaccttttttcctttaaggctaatttttcaaaccgtgttctgaataccaaaccttgctccttcatttatctctaccctcttttttgttctgtcttcaaccggttttttttttcctaggtctttcccttcattccgaaaatatgcccagggacctttaaaattcgtgggtttttttgtttttgtttttgtttttgagatggagtctcactcttgttgcccaggctggagtgcagtggcgcgatcttggctcactgcaacctccatctcccagtttcaagcgattctcctgcttcagcctcccgagtagctgggattacaggcatccaccaccactcccggctaattgtttgtagttttagtagagatgggatttctccatgttggccaggctggtctccaattcctcacctcaggtgatccgcccacctctgcctcccaaagtgctgggattacaggcctgagccacctcgcccagtgtaaatttcgtatttacatgtcttccactttttgcctctagccagagccctttctccttttcaaacaaagttagtttgtttgaattaccctcccacttgacattgtttcctcagtcagcctgctgtattctggcttctgcacttaaactcttctgaaactcctttttctgagatcattgttccatcattgcacaatgtattatacttcttacctgatgtctctgcaacccttaacccttgttgaccatttcctccttgaaactctctcctgccttggtttgttagcacacgcttctctcctacctatatggcctttcctttttattatgcttttttcttttttctttttaagagacaggttcttgctctgtcacacaggccggggtgcatgacatgcagtggcatgatcatagctcactgcagccttcaattcctgggctcaagtgatcctcctgcctcagcctcctgagtagctaagactacagatgtgcaccaccatgcccggctaattttttttaaagtttttgtagagatgggggtcttactatgttgcccagactggtctcaaactcccatcctcaagggatcctcccaccttggcctcccaaagtgctggggttataggtgtgagccactgcgcctcgcccctttttattacactttttgagttctttacttgttgcttgaacattgatagtctccaaggttactttagctttctttcctcctcttctcattttcatctccttcctggtaacctcatgaattccacacttcagctgccacctccatagtcatcactcccaaactctttctgtagcttggctctccaagacacagctgcactgttgccagttcgttggtcacacttgcagaccccacaggaatgaaaaactctttgtcgcactgtctaaactagaatactcgtttattcatttataaaatggtggacggtatcccctatctgtgaccacgaatgcagtgtacattttcccaggaattgtatcagacaatcactttgtgagtatggaagcagaaacaaggaggcaatctagaagctgtctcttaaaaaaaaaaaattaactgtaaaacagcctcaggcaggtccttcaggaggtattccagaagaaggcattatcataggagatgacagtcccatgcatgttattgtccctgaagacctttccatgggacaggacatggaggtagaaaacagtgatattgatgatcctgaccctgtgtgggcctaagctagtgtgtgtatttgtgtcttagtctttaataaaaaagtttaaaaattaaaaaaaaaaattttaaatagaaaaaagcttatagtggctgggcgtggtggctcacacctataatcccaacatttttgggaggttgaggtaggcagatcacttgaggtcaggagttcaagaccagcctggctaacactgtgaaaccctgtctctacaaaaaatacaaaaattagcttggcgtggtgacacgcgcctgtaatcccagctactcaggaggctgagagacacaagaatcgcttgaacctgggaggcggaggttgcagtgagctgagattgtgctactgcactccgacttggatgacagaatgagacttcatctcaaaaaaaaaaaaaagaaaaaagcttatagaataaggatatgaagaaagaaaatagttttgtacagttgcacaatgtgtttgttttttaagccaagtgttattaaatagagtccaaaagtttaaaattttttaaatgtataaagttaaaaagatataataacctaaggctaatttaatattgaataaagaaaagtgttttataaattgtagcttacatgtatagtgtgtataaagtctacagtaggggacgggtgcggtggctcatgcctgtaatgccagcactttgggaggtcaaggcgggtggatcacttgaggtcaggagttcgagaccagcctgatcaacatggtgaaaccccgtctctacaaaaaatacaaaattaggccgggtatggtggctcatgtctgtaatcccagcactttgggaggccaagacaagcggatcacctgaggtcaggagttcgagaccagcctgaccaacatggcgaaaccatctctactaaaaatacaaaacttatccaggtgtggtggcgcgtgcctgtaatcccagctattagggaggctgaggcaggagaatcacttgaacccgggagagggaggttgcagtgagctgagatcgcactgctgcactccagcctgggcgacagagcaagactccgtctcagaaaaaaaaaaattagccgctagccaggcgtggtggtgcatgcctgtaatcccagctactcaggaggctgaggcaggagactcacttgaactaaggagggggaggtttcggtgagccaagatcgcatcattgcactccagcctgggcaaaagagcgaaactccatctcaaaaaaaaaaaaaaaaaaaaaaaaagtctacagtagtgtacagtaatgtcctaggccttcatattcactcaccactcactgactcacccagagcaacttccagtcctgcaagctccattcatgtaaagtgtcctatataagtgtaccattttttatcttttatactatatttttactgtaccttttctatgtttagatacccaaatacttaaaccattgtgttacagttgcttatggtattcagtacagtcacatactgtacaggtttgtagcctaggagcaataggctatgccatatagcctagatatgtagctggccataccatctaggtttgtgtaagtacagtgttatgtttgcacaaaaacaaaattgcctaataactcatttctcatgtttccctgtagttaagtgacgcgtgactataagtgattctatttgaatgtgaaatgagaaatcctgcgaaacagctatcttgacaaaatcattttcaaggataatagtgtttttttaaatccatggctttatgtaaacataggtcaaatttgaatacttcagtagggttgggcgttcttaatattcaacctatgataccttttcaaagtgtggaattgtggggaggcttatacattgggtctcttttagtaagaaatacttcctggccaggcacggtgtgctgacacctgtaatcccagcactttgggagctgaggtgggcagatcactttaggccaggaatttgagaccagcctggccaacacagtgaaacccatctctactaaaaatacaaaaagttagctgggcgtggtggtgcgcacctatagtcccagctacttgggaggctgaggcaggagaattgcttgaacccgtgggtggaggttgcagtgagccaagatcgggccactgcactccagcctgggcaacagacggagactctgtctcaaaaaaaaagatagaaatactttctagcaggttttttcttatcctcactctgatgaaataatagctagccgttggtcaatggtagctgcattatctcaatcttcacaatcctatgagaacacataggtcccgttatcattgcatcttgatgtacaaatggagaaacacttggaggtttaaaaacatgcgtaagttcagccaggcatggtggctgacgcctgtaatcctagcactttgggaggccgaggcgggcagatcacttgaggtcaggggttcaagaccggcctggccaacgtggtgaaacaccatctctactaaaaatacaaaaattagctgggcgtggtaatgggtgcctgtaatcccagctactcgggaggctaaggcaagagaattgcttgaacccgggaggcagaggttgcagtgagctgagagcacaccactgcactccagcctgggagacagagtgagactccgtctctaaataaataaataaataaagcctaagttcatacagcagagttgggatttgattctaggaccacagctctcaacccgtatcgtgtttcctcctcctgttagcatgaaggtatatggtaaaagatgggagcttcccggccgtgagcggcggctcacgcctgtaatcccagcactttgggaggccaaggcgggtggatcacgaggtcaggagttcaagaccagcctggccaacatggagaaaccccatctctactaaaaatacaaaaattagccaggtgtgatggcacatagctgtaaacccagctattcaggaggctgagacaggagaattgcttgaacccgggaggcagaggttgcagtgagccgagatcacaccactgcacttcagcctaggtgacagagcaagactccttctcaaaaaaaaaaaaaaggcggagcttcccacagccaggtgcctattttccatctaaatcaggactctgagacattgtcttaatatggggaatgggattgtggttgttgtcctgggcaaacttccaggatttttacttgctatgaactaatgtgttttttttttaactggtgggggtaatccaaatgtaaccactgtactttaaggagtcatttgggtctccaagtattacatgaatgtactttttccttgcaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttcccacttgagaagagtttctgagcacctcagtaggttatgcctccatgagattttccccacggagcagatatgccagtgtatacagagaagttcaaatagatataagatgaaactatggctgggcccagtggtgtgcgcctgtagtcttagctacttgggaggctgaggcaggaggatcacttgagcccaggagttctgggctgtagtgtcctatgccaatcgggtgtcagcactaagttcagcatcaatacagtgacctcatctgggcacagtggctcaggcctatcatcccagcattttaggaggccaaggtgggaggatcacttgagccttggagttcgaggctgcagtaagctatgaccatgccccctgcactccagacttcagcctgggcaacagaggccctgcctcttaaaaaaaaagaaagaaaaacatggtgacctcctgggagtgaaagaccagcaggttgcctaaaaaggggtgaactggcccaggttggaaactcagcaggtcaaaactccggtgctgattagtaatgggattgcacctttgaatatccactgcactgcagcctggccaacacagtgagaccccgtgtctaaaaaaaaatttaaagctgaaactacatgttattgattgatttttttttaatgatttattgacatggggtcttgttacgttgctgaggctgggctcaaatgacccttctgcctcagcctccctagtagctgggactacaggcaagtgccactgcaccctgcctacgtgtactttgaaaactacattaaaaacaatgtctctaggctgggcacggtggctcatgcctgtaatcccagcactttgggaggctgatgcaggtggatcacttgaggtcaggaatttaagaagaccagcctggccaacatggtaaaaccccgtttctactaaaaatacaaaaattagctgggtgtggtggtgcacacctgtagtctcagctacttgggaggctgagccacaagaaatgcttgaacccaggaggtggctgctgcaatgagctgagattatgctactacactccagcctgggcgacagagcgagactccatctcaataaaataaaataaataaaataaaacaatgtgtctaaataagggcagtaaattctgaagagctgtataggcatgagacactaccaagctagagtcctttgcttgggacattgacttgcccaggatactaagtgaatacctattgcacagatgtcaccacaaaggaaagaagcgagagtgctgaaaggtggactagaaaaagcaaactaaattctgtggtatggagagagagcagttatagctagcctgtgagaaagtaaggcaggaatggacctctgacaccaagcgaacctttgggaagttagcttttgattgacaactaagattctgaaagagttggtaaacgggccaggcagcgcggctgacgcctgtaatcccaacactttgggaggccgaggtgggtggatcacttgaagccaggagttcaagaccagcctggccatcgtggtagaatcctgtctctactaaaaatacaaaaattagctgagtgtggtggtgtgtgcttgtagtcccaactactcgggaggctgaggcaggagaattgcttcaacctgggaggtggaggttgcagtgagccgagattgcgccactgcactccagtctgggcaacagcaaaactgtctcaaaaaaaaaaaaaaagagttgacaaatgaaaaaaattaaggatttatacagatttatatacattatagcatatgcatttaattctgctttaagacatctctgattaagttcagtgtttacagaacaaaccttattcattgtaaaataattgcaaattaaaatcaaaataagatacaagttccctctttttatgtgtcagattggtaaagttcagaaagtttaacattgtttggtaagggtgtggggaaacagacattcatccattcattaatggtggaaatgcaattatatcctctggaaaatagtttggcaatacctgtcaaatttataaatataccctttgacccagcaactccatttctaggaaggtatactataatcatatgtataaaagatacaaggatattcattacagcattatttggaaacaaactgaacactaacaatagattatgataaattatggtatatccctcaatagaatatcatgcagttattttaaaatttaaaatgaggtacagaatagtgtacacaatacactatcacttgggtagcaacataaatatatacacatatgtacttgtgcttgtacatcatagactgtctctgggaatgggaatccagaactccaggacaggagggcaagagatttttcacctcacacccttagatcaggggtcttaacctttcatttgtgccttgcagcctttggcagtttgcccagcctatggatcccttttcaaaatgtttattttaggctggatgcggtggctcacacctgtaatcccagcactttgggaggctgagtagggcaaatcagttgaggccaggaattcaagaccagcctgggcaacatagtgagaccctgtctacaaaaaattttaaaaattagctgggcattgtggtgtgtgcctgtagtgtctgctcttcaggagggaggctgaggcaggagggttgcttgagccctagagttaaggctgcagtgagccgtgatctcaccactgcactccagcctgggtgacaagagcgagaccctgtctcaaaaaagaaaaaatgttgactttaagtgcttaaagtaaaatacataggattacaaaagacagcaactatgttgaaatacagtagtccaaagtttttaaattgtggctgggcacagtggctcacgcctgtaatccatcccagttctttggggggccgagacaggtggattgcctgagctcaggagttcgagaccagcctgaggaacatggtgaaaccctgtctctaccaaaaatacaaaaaattagccaggcgtgatggtggcgcacacctgtagtcccagctactcctggcaggggcaggtagggctgaggtgggaggattgcttgagcccaggaggcggaggttgcagtgaatcaagattgtgccactgcactcccacctgggtgacagagtaagacctcgtctcagaaaaaaaagtttgtaatatgtgtgtgtgcctctttattaaatacctggtagtaggtctaaaaagcactgtgactttgcagtaatgaatatcaatggcattttgagatatctgcaataaccccaaagtctatgtgatttctactggtgacataacatgtactgctaatatttctgcagtttatgcgtacatttgttaacagtggaggatgtccaggttcttggcatcttgaacaaagaacgaaacgcacaaacaaagcaaggaagggacaaagggatttattgaaaacgaaactacactccacagcataggagctcaaaacaccctgttagagaatttttgggagtttaaatatcccctagaggattccattggttacttggggtataccctgtgtaaatggaaaggatgacgtgaagttacaagtcatttacttggcctacgccctgtggagaggatatttcctgtcatagctttagtgtgaatcagccttatgttccctgcctccagaccctattttcctgcttcacattcatgatgaaaggaaatgctatatttcagctaccagacagagaaaagataaaactttttttcctatccaaattcagacacctgacttcttctacccatgaaccccaggttaaaaatccctgccatggatactgtttgaatatgagcatgtatttttttccccaaacaacagaatttgtcatagtacacacacacttgaacagaaagagcattgctattttcagtgagaaatattcctaggacttagacgcttcactgttcagatcaaatggatataggccgctaaagcttccttgaaggcaaatacattgtgtggattttttgttttctacatcagggaagaaagaagtttattagctgaattttcacaaacatttttgtgtgtggtagaagggacagaaaaacaaagatgtgtagggcgcagctactcccttcacatcatggtgggaagcacagggaaatggtaagctgaactcagatgcagactgtgaattgcttcacagttagttacaccagtatttcaaaaataatgatatatattcaatcgtattaccctaaaatagtaataattgcttttagtaagagcaaaattttgttccatcaataacctgaaattcagcttcttttgaacttctgtaatctcttgtaatatacatgagattattaatgtgtatatacatataatttacaagtaacttttatatgtatgggatataataaaaataaatatttggtctttgtccctggttcctggcatatagttcctgaaagccttgaaatctcaactggtgtcttttgtatgctaatgacatagcttgtggctggaggcccctagtagcttcaggatgggggctggtcaccagaaacagcaaggcatgattagagggaacgttcagccctaactgcaacctctgcagaggggagaggggctgaagatgagttaatcacccatggccaattattttatcaatcatgcctccctaaggaaacctcaaaaaccttaacaatggagtttggagagccctggattaacatcaaaatgttgggagggtggtgtgcctggagggcatggacgcttaatgcaccacccccataccttgccctacacatctcttccatttgggtgttcctgagttgtagtctttataataagctggtaatagtaagtaaacgtttcctgagttttataagctattctagcaaactattaaaccagggggtgggatgggacggtcatgggaacccctaatttgtagccaagtcagacagaagtgtggttaacatggggaccgaacacttgccactgacgtctgaagtgagggcagtctggtgggactgagcccttaaacttgtggagtctgatgctaaccctgggtagtgtcgaaacagaatcgtaggacaccagttcaattttgaattggagaactggagaactgcttgatgtggaaaacccccacatttggtgtcagaagtgttttgagtaaaaacagctcagtgtattatagtgtattcatttacacaaggttaaaaatcggtttcaccccaaccatgtcaccacagggaagtcacggcctcactgatcactgagcctgtttcctcacatgaaaaatggaaatgctattctcccttcacctcaaaagattatggtaaggctgaaatgagaaacctgtgtggagtgcccaacacatagtacgtcatcaaggatagtccacttctctggtgacagagtgcagcgtgctatactgcagtttatctttctgcaagggaaccaaactccttttcagtctacaatccaaagatagactgtgataatatgtgtcagaatagacgagatacctggtttggtgaaagggagaacacagttaatggtgcattaagaatggctaaatggtcagcagtgactccagggcaagctaccagtgataaagaatcctagcaccaggtacctagctcagctttctgctgttccagtttagtactctatccaaaatgctggggaccagaagtgttcttgattgtggagaatttccatacacataatgagatattttggagatgggatccaagtctaaacatgaaatccatttatgtttcatacacacattatatacatagtctgaaggtaattttataattacttttaacgattttgtgcatgaaacaaagtttgtgtatgttgaaccattttattaccctttgtaggcaggcttgcatgggagaatctgggcctgtgtggaaaggatatatagtagctgaaggggtctaacagaatctcttttctcttggggatgctgagtaaacagtgtgttatacaccttcattttgactgtgacatgtcacatgacatcaggtatggaactttcctcacttgtggcatcatgtcagcactcagaaattttccccattttggattggattagggatgctcaacctgtattaagctgaaagcatgaaacagcatgttcacaagcatatcttaagatctgccagtatcatctcagtgaaacaaagtggatggaaaacacttgagaaaagtaactttaattttcttatctgaactgttatatacaaagatgatcactttcagagtaaaattaagaatgaccagaataattttacaaaactttccaagaaacaacacagttaaatttatagaatatgcctaaaatataagaatattcaagtgaagaaatattaagctagtgctcagaataccagactatggagtggggggcgttgcagggcagaagttgctttttgagatctttcttgccttaagcctgaatgcttcatgttcccaaagaatccaattatgggaacaaaaattccctcatattcagtttcactttaaaatacaataaacaggttacattctcaattgttattaagttgcttatacaaacttaaagtcaagagcataacttcaggatctgcactttttatgtcaagcgctttaactaagcagtttagggcctcctggatttttccacactcttttagttcttttccacgctttacaagagtctcatagtcatttgtagcctctgccgccttatcctggggagaaccaaccaactgttcaccagacaaaggctcaggggcaccaagagaggtctcttgagctagagcactaggcttagacgtcattaaccagctggacttgttttctgaagacagtgtttctccggaaggatcctcttctgtatacttggaggcttcgccactgctttcctccaccccttcttctggataatcttcaggaccctttgcttcactgctgtcgtcaagtctttcctccatgtcctccacgtggtctaaaaccatattaataagagacctcctagaagccagagatcttctagagttcatagacttatttacactactgggtatttgagatgaaaagaaccttcctggtggactgatgtcatttttgggagttgaagcatcaaattgtttcacagatgagaattgaaagagagatgtgttgaatggatttatgcttgaggtatctttaaaagaatcatcttcatcttcgccatctgaaacaatccttctagctttacttctgatttttgctttaactactacttcttctggttcatcgtctttctcagaaaactcccaactgagacatgttttgctatgcacaaaccctgctctggaattaggtgcagagccacacaagctattttctttctcaacatgctctaaagactgactggaaaaattttgtctgttgtctgctgagtcttccaagaaaagattgaaatcacatgcatactgtggtgaagatgctgaaggttcctcttccaacttggcctcacttgcttgagcatcctgcagtgcactatgggatgctgaaaggtcatcagctatttcaataatggatacatttgattctgcattttgactttcatttgttatggaaataatgggccaaggattgcaatgacgtaaaatctcatcatcctttagttgatctaaatttggcccaatatcagctttggttgatttgctaagtacataattaaaactttccagaggatcctcttgcagtgcctcttgcttaggcccctcttgtaatgtctctttttgtacagcttcatttttagttgcaaagcttttttccattcccaatgaagagttagtacaaagttcttctacacttccaaacccctttggtaaagtagctatagagtcagcactacctgtacctttaccatcttgcaaggtggtaacattcacctttatactggagagatcttgtttctcaccctctttgggcagatcatcaatgactacacttgccattttggaactgatatcttcttcctgagtatgatgagtacttagaagaggtgaaggctgaggctgtggtttattcaatttagggcatttcttctttgttgaagaaggaaatacaggttctcttagccaggccccctcatttctagttctttgttgttccatcaggaactctttattttgagactcgaattcaacgaggaattgagctttctgaaccctttgttgaatatagtgagattcttctaccacatcaagctcttctttaacagacagatcacatgtgtacatcaaatcatggtctgagattccagctatccccaaagactgcaggtaggcaatatgttcatctagttttatatcagatttcctctgagcagcatgcaaagactgaagctgcagctgggttacagagttctgaagatcctcgattgtaaagagctctcttaattcttgtttactaaaatatcggaaagggttctttttttcaccagtagtttgtcttattaatgagtccttgaaaacctgtcttctgtatattttttcctctacagtcccacaagtgattagcctataaaccacaacattctctttttgtccaattcggtaaactctatccacagcttgagcatcagttgcaggattccagctagggtcaaaaatgaccactctagttgctgcagttaatgttaaaccgacaccacctacttgagtggtaagcagaaaaacagagtaatctttattttgctggaataagttaattcttttttctcgttccaaaagatgagtaactgtcccatcgattcgcaatgtcttaaagtgcctattctttaagaggcgttcaatgatgtttagaatttgcctcgattgagaaaacaccagagtttgatgtccctcatctcgcagcctcttaagtaggtccattaggaatatcatttttccagattcttccatcaatgtgtcatcagttacttgatcaatatggtccacatctggggaatcttccccctcatttccatcttgagcagagaatgtcccaagatttagcaaacaacaagcccgtgcagacagcagcctaggatgatcacacagcttctttaagacacctagctcagccaaaggtgagcgcgtctccattagcaactccttgatatgatctaaagacacaaatttcctgtatatttcttcttgtaaaggcacaagtcgtatccaaataattaaatcatttttcctggaaagggaaggcatttcacaaatggcatcaacatctggattcttttcattaagtctggcctctgggttgcttgactttttcttctgtacgtcttctttagtcctcctgagaaaatagggttttatgattgccattaagttttcagatattttaaatcccaaggctttttctcctggggtagcatccttctctcttgctctagtaataggattttcatactccatcttaaaagtttttaatgttcccagcagggacccttgacaagcaaaatcaaatagggaccatagttcttgtaaattattctggattggggttcctgtgaggaggaggcgattacttgcaggaatagcacgagcacatattgctgacttagtagatgaggtttttattttatgtgcttcatcgaggatgacatagtcccacacaaactcttggcccctaaagcttgaaagttgctgccagttattgattaacatttggtatgtagtgataataacaccattcctttgctgaatccgattgaggtttctggtccgttcatccttgctaggaccatgaaaggttttgactctcattcctggagtccacttgatgaattcttttacccatgtgttaataagattggttggcatgatcagcagcacatgattcacaagtgatgcatcaaacataccggaaaggaaagcaatgatttgaacagtcttccctaatcccatatcatcagccaatataccaccttttcttccatccctatacaggctatagaggaaagctatgccttccttctggtgctcaaagagttggttgtgcagttctcgataaagtagcaagccagagttgcacacatctgtaaattcatcatctccctgttctgccaactcctccaaggcttcctgtattttttggattctgctcagcactttttcattgggaaaaatgtcctttgccaaattgaaaagtttaaatgcttcttccaggtctccattcttagttgcttctttggcctctttcacatatctatagaaaaaaaaagaagaagaggagaaaggaaacattgaacattcagtctaagaatgctttagagttcattttagaatccaaactgcagctggacttttaatatcctcaattcaggatgggaaagattagcacacaagatgccaatgaaagctggcgtcacttgagacacaaacaaatatccaccagatgctgccagcaacaccttcaggcactagttgtggaaaatgaatgtgcaaaggttattggttccacagtattttttttttaattggcacccataagaagtatgaagtgatattttttgtaaaacaaacctctatgtgtaggggcatggaaacatgggaacctctctggccttattttactggacctccatttaacagtattgatcactcccctcccctcttaaaattccctcctttcacgagattcctatagattccttctggttttcctcctcttcactgaccatttcttctgtgttcttcctcccagaggactcagtcctaggacctcttctcactctttttaatctctcctcaagttttcccagagcttccgctcccacctatgtgctcatgactctcaaatcactctctccaacctagagctgtccctcaagctctactctagacccatattccagctgccttctggacatctccacttgaaatcaaattcaattcatcccaaactagactcattatttcccctctaaaaacgtgcttctccatttgtatggtactaaataacactaccatctatttagccacccaaacttcaaatctgaagagaatccttgaccccaacctaaataggagtcatccttgtcctttctttttatgccccacccccaggccaggcagtcccaagtcctactaactttatttcccaagttataaccaccttctttccatctctactaccattactgtggcccaagtcaccatcatctctggcctggataactgcagcttcctacataaactgctctccctacataaactcttgcccctccaatacacactctatatagcagccagcaatactgtcttaaagcataaaagaaatcatgtcactcctctgcttaaaattcttcagtggtttatggtcaattactttcagtaagggcgccaaaataattcactggggaagaagtcttttcaactggatatccatgtgcaaaagaatgaaattggacccctactcataccatacacaaaaattaactcaaaatggatcatagatctaaatctaagggctaaacctacaaaacttaggaaaaaatataggtgtaaaaatcttcatgacttggatttggcaatatcttaaatatgatgccgaacacacaagcaaccagagggggggaagagatatacagggccgggtgcggtggctcatgactgtgatcccagcacttttgggaggccaaggcaggaggatcgcttgaggtcaggagtttaagactagcctgaataacatagcgagactgtctcttaaaaaataaataaataaataaataaataaataaataaataaataaatggaaaaaagatatacagatgggcacatgaaaagactctcaacatcattagttgtcagggaaatgcaaaccaaaaccacaaggagataccacttcccattaggatggctataaccaacaagtgggaaaataccaagtgttggcaaggtgtgaaaaactcccactattgatgggaattattaagggttcagagctgctttggaaagcggtcttgatctatgttctagagcttgaaggaaaaaataacattcttaaattattagattatttccaagttcctgaactggtaacctacccagtatcctgaaacccctatgaaacctggggttctgtgtaactctagccaggcgtctttcccagagactaaagtgctgtccctgatccttagctctgggccagagtccccactaatcacacacgccagccttttaaatggcaactgtgtgcctagacttcttagcaccagcctaaaatacttattgctgtgctctacccaccctctggaacccccatttgtcaacctctgcctgaaccacaacgagagtttacagtattccttggatatcactgctttctggctgggttaaaccgctgctgtgagccaagctgccttccccagtccctggtccaccctagttagcaggtctgtctaacaactgcatctcagctcttcctttcccctcagtctattccaccaattaagttggacctaggatggtattctttccctacaatggaatcaggaggaaaaataaatgcttttaatagcactgccctggatatctgattatttgcaagactagaatgctttttacaatgcagtttgatttagccacttaacttctaatcacttccatttttcagggcttggagggaaaacatgtcctttttattgctaatgtaatgatttatccatctatagcacacaggatccctaatgatctggataacttagctaacacttcatgggctcaagtatttttccagaattgctcccctattttccttgaacataggcagggagaagccaggcctgcttgggagccaagaggacagggaggagtaaccagttcaggacaaagaaccataaccctcaagcaagagaacaaggagaagaatagtgctagagtatggggtgaaatgtcagtttttaattccataggaatggacaataaaaacaaaaattttatgtttaaatggttttacctgaaattatatgactagagcatgtttctctttaaggattattttaaaggacatctaatcacctcccacaaggtgtctccccaaacacgtgaggattacagtctggattacaattcaagatgagattgaggattacaatctggattacaattcaagatgagattatgggtggggtcacagccaaaccatatcagtggcacacacctgtagtcagtcccagctattcaggaggctgaggcaagaagttcgcttcagcatgggaggtctaggctgcagtgagccatgatcgcaccactgcactacagcctgggtgacagagcaagacccgtttcaaaaataaaaaaaaaaagaaatattatatacaaacaactcctggaggaaggtgatacaacaattaaacttgggctacaaagtcctgttacctggaaagctacactttcgctggcaaaactgcccagttgctaaccccctgggtcataaccccacctaaaggtctctctataagaagccctgcccaagtggccatataaaatcatctctgtggctgggcatggtggctcatgcctgtaatcccagcactttgggaggctgaggcggttgaatcacctgaagtcaggagttcaggaccagcctggccaacatggtgaaaccccgtctctactaaaaatacaaaaaaattagccgggcatggtggtgggtgcctgtaatcccagctactcgggaggctgaggcatgagaatcacgtgaaaggcgggggttgcagtgagccaagatcgcaccactacactccaaccgtgcaccacagcgagaccccatctcaaaaaaaataataataataataataaaatcatctctgccccaaagctatttcctcagatgcaaacattttccttgaccatagccaattaacctctcaacatctaatccacctccctttggaactggctgataccttgagaaacctttcttctccacagagggtctgccagttcagatgctgaaaagtttttctatctggagaaacccataagccatactattagacctatgccccaaagagctaagctaagttaaacacacagtgtttacaaatgagcagctgaaaaggcacacaagcttaagttgcagaagacacacacttgattttccttgctatggagggccctttagaacattccctacaaagttattttagaatgtgaagagacagctgggagcggtggcttgagcctctaatcccagtactttgggaggccaaggcgggcagattgcttgagcccaggagtttgagactagcctgggcaacatagtgaagccctggtctctacaaaaaatagaaaaaaaattagccgggtttggtggcatgcgcctagacccagctactgggaggctaaggtgggagggatggcttgagcctgggaggcaggggttgcattgagctatgatcgtgtcaccactgcactccagcctgggctacagagccagaccctgtctcaaaaaaaaaagaatgtgaagagacagagaactgaatgcaaagaccctaactcaataaaactttgttttcttcacatgcaaaacaatcagaaatgctctttgttttgtaatctggccaccagccactaggcccatataggggtggaggagcctagacctgctaatctcggcgcatgtgagtggggttattgctgtcctctcaacaagaacccagttttgagagacaggacttgctggatttcctaggctgactaagaattcctaagcctagctggggaaggtgactacacctacctttaaatacagggcttataactcagctcacacccaaccaatcaggtagtaaagagggctcactgaaatacaaattaggctaaaagcaggaggtaaagaaatagtcaaatcatatatcgcccgagagcacagggggagggaaaatgatcgggatataaatccaggcattcgagccgggaggggcaacctcgtctgggtccctcccattgtatgggagctctgttttcactctattaaatcttgcaactgcacactcttctggtctgtgtttgttacggctcgagctgagctttcgctcaccgtccaccactgctgtttgccaccgttgcagacccatcgctgacttccacccctccagatatggcagggtgtccgctgcgtttctgatatagcaaggcgcccattgccgctcccaatcgggctaaaggctcgccattgttcctgcatggctaagtgcccgggttcgtcctaatccagctgaacactagttgctgggttccacggttctcttccatgacccacggcttctaatagagctataacactcaccatgtggcccaaggttccattccttggaatccgtgaggccaagaaccccaggtcagagaacaaaaggcttgctgccatcttgggagcggcccaccactatcttgggagctctgagaacaaagacctgtccgttaacagtttccctatactgatccagctcctggagtatctgctccctgacatgtctctatgtccagtccccttgtcaagatgcatgtagatgcattagacacaacagatgtcttttgattctccatcaaaatcaataaaacataaaacatttggataacataaaaattgcaggtgacctgaatgccagtattgaaaacaggtccatttaaagcccaagtcatggcagagtaggctaggaggattccttccttttggcttcactttcagggatggtcattttaattaaggtggggatcattttaaaatcacatataaacacaaacaatattattaaatagtgatttctgacataaattagggaaaaatgtggttcacatttcagtcaaacaatatttaataattagcttttccctgcttagcgccatttataagacaggcatttaagagtcaaaaaaacaaacaatgttgctttactcttaatagccaaaaactggaaacaaccccagcactttgggaggccgaggcggttggatcacctgaagtcaggagtttgagaccagcctggccaacatggtgaaacccatctctactaaaaatacaaaaattagccaggcatggtggcaggcacctgtaatcccatctactctggaggcaaaggcaggagaatcatgtgaaccagggaggcggaagttgcagtgagccgagatcatgccacagcactccagcctggatgacagagtgagactccatctcaaaaaaaaaaaaaaaaacaaaacaaaagtttaggccaggcacggtggctcacacctgtaatcctagcactttgggaggccgaggtgggcagatcacttgaggtcaggagttcgagattagccctgccatcatggtggaacaccatctctactaaaaatacaaaaattagccaggtgtggtgacgggttcctgtaatcctagctacttaggaggctgaggcaggaaaatcgcttgaactcaggagatggaggttgcagtgagccaagatcaagccactgcactccagcctggatgaaaaagcaagactctgactcaaaacaaacaaacaaacaaaaaaacccaccaatctgtgatatattcatacaaaggactcaataatagaaaagaacaaactactacatgtatgaatttatacatgtatgaatctcaaaaacatgctgaggaaaagccaggcataaaagagtagcaacagtgtgatttcacttatatcaagttctaaaataggcaaaactaacatatggtggaaaacatcaagacagtggttgcctctggaggtggaaaatgcctgggaaagggcgtgagggcactttctggggtgataatagtattctatatcctgataggggtttgggttacacacgtgtatgcacttgtcaaaattcaccaaatgtacacttaagatttgtgcatttctttgtatgaaaattttactttaaaagaaaaaaactaaacaaatattgaaatccacttaatagtttatatgctgaagtgtttagggggaagtaccctgatgtctgcaatttactttgaaatgtatcctaaaaaaagaagatggattgatggaatagatgcaagaataggtatgtgataaagtgagtatagtaaaatgttaataacagaatctaggtggtaggtgaaagagactaaaaagactgctttgccaatagactgctgcctatcaatttgaaggcatacaaaaagcaagattcataacacgctgcgatttggcttcttacctagcactctaatgtaactgttctcaccaaggacaccaacctccatattgccaaactccatggacagttcttagtctttatctttctggacctttctgctgtgcttaaaaccactgataactacatccctcctgaagttttccctcccgcttgggttcagtggcatacaacccttctcctagatttcttctacctcactaaccattcaagatgctcagtctgcatcttgaattcctctccatccacatatcccctataaaatgttggcatttctggggatctttttgttgtcaatgtccttctgattctatgtacatttcccagaagattttatccacgggagtgccctgtactaggttaaatagagtcctccaaaatttcatgtcaacctggagcccgtgaatgtgaccaggacattgcagatgttattgatttaagatgagatcatactggattagggtaggccctaacctcatatgactagtttacttataagaggtaaactgagacaccgagacatagagaggagaatgccacatgaagatggaggcagagaatggagtgacgcatctacaagccaaaaagctcctaggattgccagtaccaccataaactaggagagaggcttggaacagattatttctcagtctccaaaaagaaaccaaccctgctgacaccttgatttcagacttctagtttccataactgtgacagaatgtctaggttttttaaaaaaatgtggtaaaatacatataacataaaattgccattttaaccattttaagggtacaatggcattgattacattcacaacgtgtaatcatcaccactatccttctcatgataccaaacagaaactctgtacccattaagctataactccccatttctcccacccctcagtgacatctaatctactgtttgtctctgtgtatgtgcctattctagatatttcatataggtggaatcatatagtatttgtccttttgtgtttggcaggttaaccagataaccttgggctagaagattaaggagctggaggtactaaaggtctatacccattgtaaaaaccccaaagtatttgtccttttgtgtttggcaaggttaaccagataaccttgggctagaagattaaggagctggaggtactaaaggtctatacccattgtaaaagaaattaactgtccctggagaatttttcatttttagttagactttattccaaagggtcagtcaggatgttagccaccaaatgctccccaaaaataataaaacttctttctgctgaggaacattggctggtaggataccctctagatgccaaagcacatctgctatgccagaaaaaaggataattttggttttggcataattactgttatgctgtttttttccggagtgattagccagcaggttcagctgctttctgagggcatgttgttagcatgtaggaggatgcttccttcctgtttattctggcagaagggtatttgcccagttcaaccaaaagcagcactaaaatgttcaggtctgattacaaaggaggagttcaacaaccctgcctgcttttactcactttgaaatcagctttgctcttcctgcctgcttgtattctctttatgacagggtataaaggacctaaaagagcaagaagaaccttgggtctcttttgagccatatagtttggtccaaatagttcttgtctgaggaatccaaagccaataaccagataataaatattacagaaagccttacgcttttttcagtgattgctcttgtaggtgaaatagagtacggagctgacagtgtcaagccccaaaccaaaacttgtgtaggctcctatcctaagaggcccaggccaccattaaattgaatattcatgttttatacattttatttatgcatatattgtgaaatatacatatcttatatttcacaataaaagttttaaagaatgttacttgcccaccctagtggccaggggataagaccattaccagaaggtggacatgaaagcttactgagcagaaaaaaaaataaaaaaaaacacaaaaagaacaaaatacaacagcaaccattattccctacacataagcaagtgcctgaaatatgggcactccatgctgttccaggaaagaacagtgtagaactcttgcttctattccattgatctatatctatacttatgcaagtaccacactgtcttgactactgtagctttgtcgtaagttttgaatttgggaactatgagtcctctaactttgttcctttaaaaattttctttaaataatagagatgggggccgggcgcggtggctcatgcctgtaatcccagcactttggaaggccaaggcaggcggatcaggaggtcaggagatcgagaccatcctgactaacacggtgaaaccctgtctctactaaaaatacaaaaaattagctgggcatggtggtgggcgcctgtagtcccagctactcaggaggctgaggcaggagaatggtgggaacctgggaggcggagcttgcagtgagtcaagatcgcaccactgcactccagcctgggcgacagagcgagactctgtctcaaaaaaaaaaaaaaaattaataatagagatggggtattgccatgttgcccaggctggtctcaaactggccttaagtgatcctcctgtctcagtcacctgagtagctgggattacagatgtgaggcaccacggtcggctaaactactctttttcaagattgttttggctattctgggtcccctgtatttctatatggcttttataatagtttgtcaatttctttctcttttttttttttttggaaacaagagtctcgctctgtcacccaggctggagtgcagtggcacggtcttggttcactgcaacctctgcctcccaggttcaagcgactgtcctgcctcaacctcccgagcagctgggattataggcgtgcaccaccctcacctggctaatttctgtatttttactagagacggggtttcaccatgttggccgggctggtagctcatcaatttctacaaaaaagccagctgagattttcttagatgtggcattagaatctgtagaacactttgggaagtattgccattttaaagatattacatctttcaatccataaacacaggatatctttcttttatttaggccttcttaaatttctttcaacaatgttttatagttttcagtatctaagtgttgcacctcctcgtataaatttactcctaagcatttatttttgttgctattgtaaatggaattgttttggctgggcacagtggcccacgcctgtgatcccagcactttaggaggctgaggtgggcggaccacctgaggtcaggagttcgagacctgcctggccaacgcagtgaaaccccgtccctactaaaaatacaaaaattagctgggtgtggtggtgggcacctgtaatcccagctacttgggagactgaggcaggagaatcgcttgaacccaggaggtggaggttgcagagagcagagatcgcgccattgcactccagcctgggaaacagaatgagaccctgtcccagaaataaataaataaggccaggtgcggtggctcatgcctgtaatcccagtactttgtgaggccaaggcgggaggatcacctgaggtcaggagtttgagaccagcctggccaacatggtgaaaccccatctctactaaaaatacaaaaattagccgggcgtggtggcctgcgcctgaaatcccagctactcaggaggcagaggcaggagaatcgcttgaacctgggagatggaggttgcagtaagccgagattgcgccattgcactccagcctggacaacagactctgcctcaaaaaatataaataaatagactaggcgtgatagctcatgcctgtaatcccagcactttgggaggccaaggcgggcagatcacttgaggtcaggagttcgaaaccagcctgaccaacatgaagaagccccgcctctactaaaaatacaaaaaaattagcgggcgtggtggtgcacgcctgtcatcccagctactcaggaggctgaggcaggagaatcacttgaacccgggaggcagagattgcagcgagtcaaggttgcgccactgcactccagcctggcgacacagtgagactccgtctcaaaaaaaaaaaaaaaagaacctccactataatgttgaattataatgtgaagagaagtcgcaagagcagacaaacatccttgccttgttcctgatatgagcgggaaaagcctttagtctttcaccattaagtacaatgttagctatgggatttttgtagatacccttgatcaggttaaggaagttaccttttattcctagtttgttgagtgtttttgtatcacgaaaaggtgctggattttgtcaaatgtttttttctgcacctattgaggtaagaaatgtgttttttgtcctttagtttttaggcatgttaaatctgatatgtctattatcaagcagagatgtcaaccaagcaatcacatataggagtatggagttcaagaggtcaggactaaagataaaaaatgtaataatcatcaaagaaatgcaaattaaaaccacattgaaatatcacctcattcctgttagactttctattatcaaaaagatgaaagataagtgttgacagagcaggagcatcggcatcttggacaggcccctcattcagcgggagcatcggcatcttggacaagccccacattctaaagttcaccttaataaaaaaccacctaaatctaaagggcatcagcctaatggctaaggtcagcatgaccataaaccacaattaacatctccaaccagaaacattccaaactcctccctgaccagagacatgctagccccaagataacccccctctggccaggaggatgccagccttgagataacacccctctggccagaaagatgtctgccccaagataacctcccctcctcccagagagattccaaccccgccataaaacttctccctcacacagaaacattctaagcttgtgataagccccctcaccctaaaaccaatatatactgttagtctgtaagagaaagcactcctgaccaaaattggccagaaacccctctcaggttttatctaaagtaaacctgcctctaactgtcaagcatttgtgtttcttttctctttctttaactcttatatttggtgccgaaatctggaacaggtgctgggggcagaggctctcttgcaacccaggaagcagtgggcaacggcagctcatcataagttaattcctggatcctgagggtctctggtcacctgccccgtcttttctctcacttcatttttggagcgatttgcatgaggacaactaacctgaaggggactgcaaggctctggccggggctactccccaacaagtctttaaaccttcagatcttgggaatccacctccaacttcccacaatgggtattttgccctctcccctcctcctcccttctctctttctctcttcctcatgtggctctggtttaaggggccctttgccaattccaactggaacatccaacattggacactaatccagccaactgctaagatctgccctcctctggctttctcacggtaccaggaaaagttaggtctgccatcccggtcctcagaggaccagcaggactaaaaagctagaagaaatcttggggatgcccagttttcatctcagcttgaccatcctctttagaaagaggacgccgggtctctgtctttcatctggggatgcctagaacaaaaacagacaccctcggcttcttctcaccagtccacatgggtgccaaacaatcccacattcctacatcctccccactgggctgcctccttcacaacctcaccaaacttggcttaccgggaagcataaagccaaagcatttagtcttttattgcaacatggtctggctgcaatacacattagataatgacagccgatggttggaaaatgtcaccttttacttgcaaattcttagggacctcgacaactttataaccaggaatggcaaatggcaagaggttctctacattcaggctttcttctaccttagctcccaaccctccctatgtcaagcttgcacccctcatgaagtccttcttctcaatgaaaatgctgtctgggtctctccctcctccaaaaacctttcctctgagatcccttcccgcgaaaacccttcctccaaaaccccttccctcgaaaccccttcctctgaaaccccttttgaccctgcagatgaacccccttcgtattcccatccccctggttctgctcctcatccttccaaaccctccaccccagggggccctcctgccctcaagcctccagccccaaaccccactcctcctccttctccacctgttacccgttcaaaagccaccagtcaaaccaccccagccattctccctctccgggaagtggctggggttgaaggcattgctcgtattcacatccctttctccaagtctgatttgtcacaaatcaaacggcagctaggatccttctctgacaatccctatcactatcgcagggaattcctgcacgtaacccaatcctttaatttaacttggcatgatatttatataattttaacctccaccctcactcctgatgaaaaggagagcatctggtgttcagctgaagcccatgcagatgaactccataaccaagcccctatataaaatccagtggccaatgatgcagtcccccatagagacacagactggacttaccaacagggaaacaatggcatcaggcgacagaaccacatgattacctgtctcctcacgggcatgaacaaaaatgcccataaggcagttaattatgaaaaactcagagaaattacaaaggagccccaggagaatccagcctttttttttttttttttttttagatggagtctcactctgttgcccaggttggaacgcagtagcgcgatctcagctcactgcaacctccgcctcccaggttcaagcgattctcctgcctcagcctcctgagtagctgggattacaggcgcgtgtcaccacgcccagctaatttttgtatttttagtagagacagggtttcatcatgttggtcaggctgatctcgaactcctgacctcgtgatccacccgcctcggcctcccaaagtgctgggattacaggcatgagccactgcgcccggcctgaatcctgcccttttcttatcacatctcactgaagccatgctaaaatataccaatctggatccagaatctagagaagggcaaacttttctccacttccaatttatttcccaatctgccccagatatccagaaaatattacaaaaattagaggaaggtcagccgggtgcagtggctcacgcctgtaatcccagcacttttggaggccgaggcaggcggatcacgaggtcaagagatcgagaccaccctggccaacatggtgaaaccccgtctctactaaaaatacaaaaaaaaaattagccgggcatggtggcaggcgcctgtaatcccagctacttgggaggctgaagcaggagaatcacttgaacctgggaggcggaggttgcggtgagctgagatcacgccattgcactccagcctgggcaaaaagagtgaaactctgtcttaaaaaaaaaaaaaaaattagaggaaggtccccaaacatctcagcaggacctcctaaatgcggcctttggagacagttttgctcttgttgcccaggctggagtgcaatggcgtgatcttggctcactgcaacttctgcctcccaggttcaagcgattctcctgcctcagcctcccgagtagctgggattacaggcatgcgccaccccacccagctaattttgtatttttagtagagacggggtttcgccatgttggtcaggctggtctcaaactcctgacctcaggtgatccacccgccttggcctcccaaagtgctggaaggccttccgtgtctttaacaacagagacaaggaacaaaaaattcaaaaagacaaacatgtctggttaaaataccagatgctcacctctgctgtccaaaggtcagttacacaaaagcctccagacaaccccaagggaaactccgtcacctctctggaagtgtcaccctgaagtgccacatcagggttccaatgtggcaaccctggacactgggcaaaggcttgtcctagcccctggccccctaccaaaccgtgcccaacttgtggtctttggggacactggaaaatggactgtgcccaatggatacaccctccctgttcaagtgtagccctgtgaggccccctgaccatcacaggaggaaatatcttcactgctggtactgacaacggaagactgagggtgcctggaatccttcacccccacatccagtgagtccatggaacccagggtaattgggacggtatccagtaagattatttcctttctcctggatactggggcgagcctatcagtattaactgaatatcaaggcccactagaatgttcataattttctgttgttggcatgaaggacatacaagaacttccatacaaaacactgcctctatactgctcatttcagggagtcactctcactcactctttcttggtcattcctcattgtcccactcctttactaggaagggacatcctacacaaactagggggaatcattcattcatcggccctacatcaaagccacccttacttattattatgtcaagaaaaaaacccctcctcagacactccacatcaaatagacttaaaacccaaattcctggctcacgcctgtaatcacagcactttgggaggccgaggcaggcggatcacctgagtttgggagcttgagaccagcctgaccaacatggagaaaccctgtctctactaaaaatgcaaaattaactgggcgtggtggtgcatgcctataatcccagctactcggaggctgaggcaagagaattgcttgaatccgggaggtggaggttgcagcaagccaagatcacgccattgtactccagcctgggcaacaagagcaaaactctgtctcaaaacaaacaaacaaacaaaaaacacccaaatccctcagccaggtaaatcctatagtatggaacactgactcccccataatagctacccaccattctctaattcaaatctcactaaaggatcctaagcgctacacagtggtcccacaatatcacctcaaccctaatggattacagggactcaagcccatcatctactgacttttggctgccaatattttaatccccacccattctccccataatactcctattctcccaatcaaaaaaccagatggctcctatagactggttcaggatttgtgataaatcaactccactgttgttcctgtttatcctattgttcccaaacccctacaccctcctattgcaaattcctcccaacactagccatttctcagtattggacctcaaagatgctttttttactattcctctacatccctcctctcaaaacctttttgctttcacttagaccgaccctgacataggctactcccaacaacttacctggactgtcctcccccaggggtttagggacagccctcactatttcggtcaggcacttcaattagacctctcccagctacatctacaacctagcatcttgcttcagtacatggatgatttacttctttgcagcccctctctagaacattgtattcaacacaccaccaggcttttacattttttgtctgaatgcaggtaccaggtgtccaaaaagaaggcccaattaacctctccaaaagtctcatacctaggattaatgataactccaaatacttgagaaattctgccagcatgaaagcaaagcattcaacaaatcccttttcctaaaacaaaaagggacttactttctttcctcggattagtgggatatttctgattatggatagcaaattttgccattatcactaaacccctttatgaacacacaaaaggcaatcttgaccaaccactcactcccactccagccctttatcatgctttctctcaccaaaaacgtgccttattacaggcccctgctctaggccttccaaaccccctgagatcctttcgtctatatttacacagttctcataatcaggcccttggactattagcccaacccatgggagactccctccaactggtaacatatttttcaaaacaactagaccccatttacaaaggttggcccctttgcttaaaaattttggtcacagcccctctaattatccctgaggcacaaaaactcacattctacaaaccccttcaggtattttcttttcacagtctgcaaaatatactcagccataaggcgctaagctccatctcatcctcctgcatgcaggccttacattcacctctccttcaacactctatctctcttcatagatgctccccccttaatcctgccactcttttgccttcaggaccaattttagacactgaccaacactcatgcttgaatttaattgaaagttctctcaccatgttctacccccttacttccactcacataaagcaagccccagattggtttatagatggcagtgcatcagaaaacccttccctccaagcagggtatgctatcattgagggatatcatgatgatacccacctagaagagtcgtagaggctgcccccttgcctttgggcatatcctcccaacaagcagatttatttgccctaataagagcactaaccctagcaaaaagtacacaagttaacatatacaccgattctaaatatgcctataacaccatccattccaatgcccaaatttggagcgagcggggctatgtcacggctaagggatttcctatcattaatggaaaactcatcacttactaaaggcagctttacttccagaaaaggttgcagttatccattgcaaaggacatcaatcagataaaaaccacattccaataggaaaccgtgaggctgagtattgggcaaaacaagcctcaaccaaccatccaatcccccaatacctattaagcctcatacaacatatcccctccttttatccagaacaccaaatacagcaactaatcacagcgggggcacaagtcaaacccccatactgctttgtacaaaacaaattagtcccatctgaccctgaagaaactgctcttttataggacattcacaacctcttccatactagccattccccttgacaacatttcttaagctcccatatacacataaccccagatataaaggaacagctaaaggccatttcccatcaatgttctacttgccaaaaggcttcaccctactccaacactaaatccctttctttcccaacccatcaagccaggggacaccttccaggacaggactggcaaattgattttacccatatgcccccagttaaaaaggttcggtttcttccagttctcatcaataccttttcaggatgggtcgaggcttttcccacaaccaacaaatgggcttctactgtcacctccaaattaataatggaaatcatacccaggttcagggtgcctctttcttttcaatccgacaatggtcctgaattcatctctcaaattactcaacacttgcaccagctctacatatcacctggaagctatatatcctctatcgacctcaatcttcaggaaaggttggaaaaatgaatggcattctaaaaaccaccctcaccaggtactcactccaaactcttaaagactgggttacacttttgcctttggcccttctaaaaatttgggcattcccacataaacccttaatgctcagcccctttgaactcatgtatgggaaaccactggccccttttgttccacctcagggtcaaacaccacctctaccaactccccttgtttcccctcttctgtatattatccgccatttcatttgggaatatgctgacaaatacctgccacaacccatcactgactcctctaatcccttcctatagccagaagactgggttctcataaaagatcccagtcctacccccaattcccccctcacacctaaatggaaggtgtaaaaagtaaagtagaggttcctcttcaaagactttcctccccacctaattaggaataaatagtaacttctcttagaagcaaaatttattcaaagacctgtgctaacatccttaaatatcggccagccgtaataaagaaatcaatgtactttatgttcttagctcctacaatttagcctaaatatttgccctggcatgcttatactagtccaagcaaacattaggtcatagcctgttcctcttccttatttgaaggtgtttttacctttctcagcattccacaagttacttcctccttcctttgttctcctctgtctttgcctcttttaaaaagttctaagttgctagccaatcgggacaaatacagaatgtgaggtcccgttccagccaatggaaactggacacagcagtagggtggaagcgtcagtttataaatgaccctgtctcctttgttcggtgtactctcatggcaaaactgctggcgagggtgctctttctgcagaaagtaaaaatggccttgctgaggaaattaattttatgttcaagtgctatttctttatggcaccagggaacaaacatttctaacaaagggaccttaccaaatcattcttaccatacccacagcagcaaaactccagggactccccaactggtttcattatacttctctcaagaaaacagacttccctttgccacatacccaaacaaccaaatccaaaaccccttcagccttctcttgtgtctccacaggacccacttccctttgcctcacccgaatcttggaagaaaaggaagagaaattcacctaaaccacttatgtctctttctctcccaaactttcactgcttcctaatcaaccttgttacagtccttcagcggtacccttacgaaactcccattatatatcctgatcagctctttactgttctatgggacctatggcttcaaggaactttccaggactttactcttacccaaataacctttttcgctttttgcttgtttttttttcaatacaaataccctaagtacatcaacctcaccaatacaaccacttctcactgctctcaagctcgaactataaaccttacacaatccctcttgctgcgaactaactcttcctttgctcctgaatgctggatgtgcttatcgctgtcttcctcagcctacacagcccttcctgcatcccttcatgaccttttagcagggagcataaccctaatttatacactccaaaagggagcttcctttcttgaaagagctgacaccctggtcggcaattatcctacttccagggccaatcaggctaacaaattatttcaaacctattacaactccctgcaacgcctcaagcctcaagactctcccattaaagggcctataactaaacacaccccccttttacaacaagcttcactttgcttttcagcctctgaaggaaatctccctgtaggatccttaacacctaaccaacgcaaccgtactatcattattaaacacccctctgaccatcaaactaaccgagttaactacccagtatcacctgaagcaaatggagcatttccgcaactggctcgtttgacagcctctctctcagccaatgcctatggcctaacttgtgctgtgcctggtgcccacctttttccatggctcaatatcaatggtgcaacatcctattgcattaaatgtgtaaaaagtaactcttcctatatttctactatagtaggtgtctccctggcctcctccttgtccatttggagtaatgaaccacaggaaagaaaaaacaccccatgtttagttcacctactgtctttccatatctctgcctgtatacacgacaaaggcctgttctttttgtgtggcaccaacacatacctttgtctccctaccaactggactggaacctgtaccctagtttatctatctccctccattggacttgttcctcctgatcgacctttgcccatcccacccatccaatatgttagaaaaggaagggccatccatgtcattcccttaatagccaccttgggtataacctctggacttggattgagagcaagcagattagccacttccataacatactttaaggctgtttcaacagaactacagaactcattagaagacacagccccaagccttataaaagtccaagaccttggccaggcacggtggctcacgcctgtaatcccagcactttgggaggccgaggcaggagatagagaccatcctggctaacacggtgaaatcccatctctactaaaaatacaaaaaattggctgggcgtggtggtgggcgcctgtagtcccagctacttgggaggctgaggcaggagaatggcatgaacccgggaggaggagcttgcagtgagccgagattgcgccactgcactctgctctgggagacagagcaagactccgactcaaaaaaaataaaaaaaaaaattaagaataaaggattgatcaggctatttgaagagcaacctcatcatatcccacaattccaaactcctccccaaccagagacatgctagccccaagataacccccctctggccaggaagatggcagccttgagataacccgccttggctggaaagatgtctgccccaagataacctcctctcctcccagagacattccaaccctgccataaaacctctccctcacacagaaacattccaagcttgtgataagccccctcaccctaaaaccaatatatactcttagtctgtaagagaaagcactcctgaccaaaaatcggccagaagcccctctcaggttttatctgaagtaaacctgcctttaactgttgagctgcattttgtttctttcctctttctttaactcttacaagtgttggcaaggatgtggagaaaagggaacgcttgtatactgttggtactattataaattagcatggacattctgggctgggcatggtgcttcacgcctgtaatcccagcactttgggaggcctagggtgggcagatcgcttgagctcaggagtttaaaaccagcctgggcaacatggcaaaaccccatctctaccaaaaatacaaaaaattagccaggcatggtggtgtgcacctgtgatcccagctacttggggggctgaggtgggaggactgcttgagctcaggagccccaagcttcagtgagccgagatcgtgccactgcactccagcctgggtgacagagggagaccctgtctctaaataaataaatacatacataagtatggccattctggaaaacagtgcagaggttcctcaaaaaactaaaaataaagttaccatatgatccagcaatctcacttctgggtacttccaaaggacctgaaatcagtatattgaagagatacctgcactcccgtgttcactgcagcattattcatagtagccaagaaaaggaaacaaccaaagtcaccatcaacaggatgaatggatttttaaaatgtggtatatacacacaatgaaaaattattcagccgttaaaaggcaggaaattctgatttgcaacatgaatgaacctaaaagacattttgctaggtgaaataaaccaggcacggagagacaaatactccatgatctcgcttatacatggaatctagaaaagaagtagagagtagaacagtagttaccagaggctggggggataggggtagatggggaaaggagaaatgttagtcaatggtacaaagtttcagttaaacaggaggaataggttctagtgatctactgcacatcatggtgactattattaataataatgaatcatatatttcaaaatagctaaaagaatgaacttttttttttttgagacagggtctccctctgtcacccagcctggagtgcagtgtgccatgatctcaggttactgcagcctccgcctcctgggttcataggattctcctgcctctgcctcccgagtagctgggactacagatgcgtaccaccacacacaactaatttttgtatttttagtagagacagagtttcgccatgttggtcaggctgaagaatggattttaaattttttcaccacaaagaaatgataagtatttgaggtgatggatatgttaattagcctgatttgatcatttcacaatgtatacgtgcattgaaacatcacattgtaccccacaaatatatacaattattgttggtcaaaaataaaactggtcaagtgcaatggctcatgcctgtaatcccagcacatttggaagccaaggcagaaagatcgtttgagtccaggagttcaagattacggtgaactatgatggcgccactgcactccagcctagatgacagagcgagaccctgtctctaaaaaaacagaaataaaactgtactccataaacatgtataattatgtgtcaattataaataaacccaaaaactttaaaaataaaataaaataatgccaaagtaaaaggtttactaaaaaaatgtgaaagttctcagcacagagatgagatttaaagccaagaacctggataagatcacccaaggaaggagtattaaaaaaaaaaaaaaaaaaaaaaaaagacagctgggcatggtggctcatgcctgtaatcccagcactttgggaggccaaggcaggtggatcacttgggctcaggagttcgagaccagcctgggcaacatagccagacctgcctcaaaaaaaaaaaaaaaaaaaaaagacatggcattccaacattaagatcatctatagaattccagctaatgaatacacaaagaacggtgaaactagaaaatcacgactttgcagccaggcttggtggctcacgcctgtaatcccagcacttggggaggccaaggcaggcagatcacctgaagtcaagagttggagaccagcctggctaacatgacgaaaccccgtttctactaaaaacacaaaaaattagccgggtgtggtggcacccacctgtaatcccagctactcaggaggctgaggcaggagaatcacttgaacccgggaggtggaggttgcagtgagctgagatcgcgtcattgtactccagcttgggcaacaagagcgaaactccgtctcagaaaagaaaatcaccactttgtaatctctaataactgatttgacactttgggaggctgaggcaggtggatcgcttgagactaggagttcaagaccagcctgggcaacatagggagaccccatctctttaaaaaaaaaaactgatttgagcaataattatcaatggttgaaagcctgatgggttggtggggaactggatattcacagaatactaagctatcctgaacgtattacttcctcatcataagggggaaatgcaactttgcaaaggaggaatcagattgtaatcactgaacccattgatcaacctttcaatagcattattgaaagtaggaaagtcagatgttatatacttcctgatatgacacaatatagctacacagccttccctataaagtattcatgccaaaaatattgaagcttaatcttatcaagcctttagtttaaattataggagacagaacaaactaatgacactacaaggaagacatcacactaattcaaatcattgtcatagaaataaaagtggaggggaggggagaactgttctagattagaagttcaagaaacataaaacccaaatgaagttgtagaccttctttggatcctgataaaccattcaaaaatttgaggctgggcatggtagctcacgcctgtaatcacagcactttgggaggccgaggcaggcgaatcactggtcaggagttcaggaccagcctggccaacatggtgaaaccctgtctctactaaaaatacaaaaaattagctgggcatggtggtgggtgcctgtaatcccagctactcgggaggctgaggcaggagaatcacttgaacccaggaggcgaagtttacagtgagccgagattgcgccaccacactccagcccggatgacactgcaagactccgtctcaaaaaaaaaaaatttgaatatggactatgtattagataatatcaatgaattcatttattttgttaggtgtgatatggcatggtggttttgtaagaatatggttttttttttgaccgggcaagggggctcatgcctgtaatcccagcactttgggaggctgaggcaggtgaatcacctgaggccaggagtttgaggccagcctggccaacatggtgaaaccccatactaaaaatacaataattagcctggcgtggtagcaggtgcctgtaatcccagctacttgggaggctgaggcagagaatcacttgaacctgggaggcagaggttgcagtgagctgagattgcgccactgcactccagcctgggcaacagagcaagactccgtctcaaaaaaaaaaaagaatatgttctttttaaggaatatatacttaagtatttcagcgtgaaatgtcatatctggggatttaaattatcttagaagatatgaggaggaatatcaacagaatctgaagcagcagtcagtgaagtaagaagaaaatccggagagcaagggctccttggaagactaatgaatcatgtgtttcatggagaagtgattaacttcgtcaagtactactggtcgaggtagatgaagattgagaattgactgttggatttagttatatgaatgtcattggtgactttgataaaagcagtttgtgtaaagtgatggggtgaaaacctgattgggacgagttcaacagaagttaggagaaaagaaataggaaatgacaagtgtagacaatgatatgacacctggaattttgctgtaaaggaaagagaagaaatggagcaataactggaaatgaaaataggatcaagagaggatttttttttttaacaatgaaagaattggtgggctgaagtccttataccagtgagtgacaagggatgagatcttttgcacaaatggaggggttgtgccttagctagaagcatggagagttcatccatactaacaggacagaaggcaaagaacacagagggaataatgctgggaagtaggttgatatggaagaagcttctggaaactgtcttctgattgcttctatcaacccagtgaaattggaagcaagagagatgagggtgagatgttgagggtctgaaaagcaagaaggcatgaaacaggcatctagtacaatggatgagtgaatacattagagaaatgtactatgattgccaggcagcatgaagggcctgcttgacatcgatattgatggatttcaagtaagaccagtcacatgattgtttcttcaaccatgttcatctgagagggccagagttggatttagcaaaatgtattagtttcctattgctgccgttacaaatcatcacaaatgttaaaacaacacaaagtattatcttttatcttacaggttatatcttgcaggttatataggttagaagtctgacacaggtctcactgggctaaaattaaggttgcagcaaggctgtgttcctttctggaggctctagggggagaatgtgcttcttgcttttccagcttccagaggccatacacattccttggttcatagccccttcccccatctaccgagccaggtaggataggttgaatccttctcacactgagtcactatgacctcctcttctgcctccctcttccacttttttttttttttttttttttggagatggagtttcacttttgtagcctaggctggagtgcaacggtgcgatctcagctcactgcaacctccacctcctgggttcaagcaattctcctgcctcagcctcctgggtagctgggattacaggcgtgtaccaccacgtccagcttatttttctatttttgtagaaacggtttcatcacgttggccaggctggtctcgaactcctgacctcaggtgatccacccaccttggcctccccaagtgctgggattacaggcgtgagccaccacacccagcccctcttccacttttaagcaccctgtgattacactgggctcacccagatattccaatttccctattttagggtcagctggttagtgaccttaattcctctctaccatatgagggtaacatattcacagggttcagaaattagtatgtggatatcctcgggaggccattactctgcttaccatacgaaggctatggtcttgccaagccagtataattaagtgtgaaagagaaaaaaaataagttaaagttgtatacaaggaagcctccacaattattgactctgaacttcaaactatgtaaggagagaagtgagaacctgaggggtgtgcaacagtgaaaagatggaatcaatgaactataggtcccaacaatatcaaacatttgttggaattggtattctagagggagtaaggtagaagatggagagtagaatgcttgaacggtggtgtaataatgtaagtgtaataaaaagtctgattctgctgggcatggtggctcacacctgtaatcccagtgctttggcagcctgagttgggaggatcacttgagtctaggagttcaagaccagcctgggcaacacagtgagacttcatctctacaaaaatcttttttttcttttttttctgagacggagtcttgctctgttgcccaggctggagtgcagtggcgccatctcagctcgctgcaacctccgcctcctgggttgaagcaattctgcctcagcctcccaagtagctgggattacaggtgcccgccaccatatctgactaatttttgtatttttagtagagacggggcttcaccatgttgtccagactggtcttgaactcctgacctcgtgatgcacctgcctcgccctcccaaagtgctgggattacaggcatgagccactgcacccagcctacaaaaatcttttaaaaattagccgggcttcatggcacacacctctggtatatgtttatatgtacagtaagtcctcagttaacgtggtcagtaggttcttggcaactgcaactttaagcaaaatgacacacagcaggcccttgaatgacactggttcattcaatatcattttgctgcaacactgatgagaaaaaaattggttttgctacgtcatttcacttaaagtcagtttccaagaacctatggacaatgttaagtgaggacttactgtatacacacgcacacacatctttgctcactcatgtaagtgtatctgtagaagaaaatactacaagtcttagcttcaaaagtaaaactatgtatcttaacttttgaattgactcatatagctcatcacacaccagcctgagagaatataaataaatgcttactcacactattgactttattaaaatctggcatggttttcttgaatggcaattttaaatacacattccctaagacccagcaatcggaattccaaagtgtacactcagttacgaagtgcacaaaaattcacacaaaggctgcctattacaacaaaagtataatggcaaacaattggaaaaatctaaatgaaaggcctggcatggtggcccacgtctgtaatctcaacactttgggaggccgaggcaggaggattgcttgaactcaggagtttgagaccagcctgggcaacatggcgagaccctgtctctactaaaaacacaaaaaaaatactttgggaggccgaggcgggcggatcacgaggtcaggagattgagaccatcccggctaacacggtgaaaccccgtctctaccaaaaatacaaaaaattagccgggtgtgttagcgggcgcctgtagtcccagctactcgggaggctgaggcaggagaatggcgtgaacccggaaggcggagcttgctgtgagcccagaccgcgccactgcactccagcctgggtgacagagcgagactgtatcaaaaaaagaaaaaaaaaaaatagctgggtgtggtggtgtgcgcctgtggtcccagctactccggaaacaggtgggaggatcgcatgagccccgggggatggaagttgcagtgagctgagttagagatcgcgccactgcactccagcctgggtgacagagccagaccctgtctctaaaaatatatataaaacaacaatagtaaaataataaattggctggacatggtggcacccaccttaagtcccagctactagggaggctggggcaggaggactgcttgagcccaggagttcgaggctgcagtgaactatgatcaggccactgaattccagtctgggcgacacagcaagaccctgtctcaaaaaaaattaaagcagtaaaattcacagagacagaataatggttgctaggggctgaagggagggggaaatggggagtttgtttaatgggagtagtttcagttttgccacatgagaaaagttctggagatgacggacggctgcacaacaatatgaatgtagtcaacactactgaactgtacatttaaaaatggttaggatgataaactttatttttcataaaacccagtttctgcacaaaaagataaaatttatgttatgtgtactttaccacaatttaagaaaaaatttaaattctcatcccaacattaccacgccccccacccttagccaactggtgaatgtttactcatttttcaacgcctagctcaaatgtctcctcttgccacgccatcccttagctgaccacccttgtagttggccattccctcttttatgccaacactgtgccctgcacgtacattatacctcttacagcacttatcaaacctagtaattattgctttacagatccgtttccactactagattacaaacaatttgggggcggggaccttgttttactcatctctgtatcccctagacttagggcttgataagctgaaaagaatcaagaagggcttgattaattaaggctcctctggcttttaaggagaccatactggagggtcatttgcccaaaagaagaggcatcggggtctcctcaggttttagaaatctggtcaaacatccagagctgactcccacaccctactgcgagaagagcgcgagcgcgcgtctcaaaaggctccgcctcaacagttcgggtccccaggaggatccgggggccaccccacctccaccctgggccaggtcggttagctagacccgcccagcggtccagacataccttaggtaatgagcagcctgctctgggctcaaggcctcggcttccggaaaccttcgggatgcctccatgaccctcggattgggttccagttaccccggcgggagtttggagcttggagcttggagcttggagcttggagcttagagtttggagcttgaatttcgctcactcccgccccgcgcatgctctgtgcgccgtggagagggacacagccaaccgacggcctcgcggccggccaatccgcgaccacgcgctgcgacgcctccgcctgagccccgcccatgacggtgggcgcctgcgcctacgcgcgccgggaagcagaaggtgatctctgccttcgagacacggagtgtgctgcctcagtctgtgatccctcgcgtttcaatccaattcaaaccatgctgcagccaattcgttcgcgcgtgcgtgtgccatcattgtgagtggaggagactgcccgatatgatcccagtcattgcggcgacccctggagatctccaacgcctgcgtcccccaaccataccctgccccgcatccacagatatcttcccttccttgatcgccagtacctggcactgaccgtgctttgaattcaaacaccctgggaggcatagtccctgtgatttaaactaacattgaagaagcgaccagacgcggtggttcacgcctgtaatcccagcactttgggagaccggggcgggcggatcacgtgaggtcaggagttcgagaccaacctggctaaaatggtgacaccccgtctctactaaaaatacaaaaaattagccgggcgtggtggcgggcgcccgcagtcccagctactcgggtggctgaggcacgagaatcgcttggacccaggaggtggaggttgcagtgagccgggattgcaccactgcactccagcctgggtggcaaagcgagactccatctcaaaaaaaaaaaaaaaaaaaaaaaaggctgggtgcagtgcctcacgcctgttatcctagccttttgggaggctaaggtgggaggatcacttgcacttaggagttcgagaccagcctgggcaacatggtgagactcccgtctctttaaaaaaaatttttttcttctccacagggcgttatgctgtatttattttcttaaaaagagagagagaaagagagaagggtcttcaagaatctcaaaccctggaggtggaggctgcagtgagccaagatcatgccactgcactccagcctgggtgacagagaaagactccatctcaaaaaaaaaaaaaaaattaaagttcttatttaagaaataagtaactaggttcacatacttggtataataaaaggaagacaaaaataatttaaaaaaaaagaagtagtgctgtggtcatcatttcttcagaagcaccaactaagatacagtcattttcaaatgcagagcctaaaaagaaggcagagcctagagcttaaggaaatgtgattgagtttaagtggcttgcttgggtgacactaaataggaggttgtgggccaacaaaaattgtccttgttcatatactgttaagaacacagacatgactcctcaagacactaatttagcattcagtattggaaaactcacctattggcccagtcatacatcatatgtccagagaattttaagcttttcataaaatttatagaccgttatgagttaaaaggaatgttggaggccgggttcagtggctcactgaacctgtaatcccagcactttgggaggccgaggcgggcggatcacctgaggtcaggagttcaagaccagcctggccaaatggtgaaacccccgtctctacaaaaattagctgggcatggtggcgggtgcctgtaatcccagcttctcgggaggctggggtggaagaatcgcttgaacccaggaggcagacgttgcagtgagctgagatcgtgccattgcactccagcctgggcgacagagcaagactccatctcaaaaaaaagaaaagggttggggggaggtgggggatcttggagaacatgggctattttcctggtttgtatgactttaaggcctttattaagaggccttttagtatactattatccacatttttcagatgtggaaacaggctcagagagataaattgacttcatctaagcttcctgagctaggaagcagcagagccagaattcaatactaggtccatatggacacaaatctgtgccgtttcgctgtgtcacactggaaagaagagggcagtggcgggaaatgaggttgatgaggcagttgaaggccaggttatgaaggaacttgtttactctgctaaagtgtttgaatcacatcttttcctggaggcaagcttggattgggctgtgctatggtctgaatgtccttcaaaattcttgtgttgaaacttaatccccaccatggtggcattgagaggcggggccttttagcaagtaatgtcatgagggatcctacttcatgaataaattagtgccttatgaaagggctggagggagctagtttaggccctttttgctcttctgctttcctaccatgtaaggacacactattccttcccctccagaggatgcagcaacaaggcaccatcttggaagcagagagcagccctcaccagataccaatcctgctggcaccttcatcttggactcttcagcctccagaaccataataaatacatttctattgtttataaattatgagtttgatggccaggtgaggaggctcacgcctgtaatcccgccctttgggaggctgaggcgggcagatcatctgaggtcgggagttcgagaccagcctgacggagaaaccctgtctctactaaaaatgcaaaattagccgggcatggtggcacatgcctgtaatcccagctacttgggaggctgaggcaggagaatcacttgaacctgggaggcggaggttgtggtgagccaagatcacgccattggcactccagcctgggcaacaagagcgaaactccgtctcaaaaaaaaaaaatatgagtttgagtctatggcattttattatagcagcacaaaggagctaaggatgagttgagagtccaggcgccctggatacccaaaggatgagtaggatgagaagagcagaataggggagaagatgtaggagagaattctgcagaaaggaaaagagagatgagagcacaaaaatcttcatcttgagtctggggaaggccatgtctggttgtgctttggctcagggtccaccatcatcgctcatatccggggaattgttgagaactgaagatgaagcaaagcaggcccctggtggttgttgtaggcatgccccattgtgggctgtgaagaaaagctaaagagaactccctcaggaaccccggctacctcctctctgcttcccagctggcagtgatgcctaaaggccctgatcaccgggaaggaaggaccaacactcggcttgcctgccctttggctattggattttctaagccccattttcacacagctgtagggctcctcctttaaactccccagctctggctgctcctcccctccccttcggtcctgtagtctgcttcccttgggcccttcttggtgccttctggagtcccaggtctcaacccagggctctgatgacccaggaaactccccagcccaggctcctagtcctcctttataaatggtcacccaggctcacagcctgaaaataagagagagattgggaggattttgagtgggtaaatggagagaatcaaagagagtcaaaataatagttactactatatccctcttatgtgacaggccccattcaaaacactttacatcgattaattatctgctgttcctcattatgcatctaccccaatcaagggctcccattcccccagcgtctctcaagggaatggggtttataaagctctcccagctgggctcagtggctcacgcctgtaatcccagcacttggggaggccgaggcgggcggatcacaaggtcaggagttcgagaccagcctgaccaacatggtgaaaccccgtttctactaaaaatacaaaaattagcgggtgtgatggcacgtacctgtaatcccagctacttgggaggctgaggcaggagaattgcttgaacccaggaggcggaggttgcagtgagccaagatctcactactgcactccagtctgggcgacagagggtgactccatctcaaaaagaaaagaaaagaaaaggaaaaagctcttcctaggctgggtgcggtggcttacatctgtaatgccagcactttgggaggtcgaggtgggtggagttcaagaccagcctggccaacatggtgaaaccccatctctactaaaatacaaaaattagccggccatgatggtaggtgcctgtaatctcagctactcgagaggctgaggcaggagaatggcttgaagccaggaggcggaggttgcagtgagccaagatcatgccattgcactccagcctctacaagagcaaaattctgtctcagaaaaaaataaacaaaaaaagctctccctaattattgttaattttaaaagggtgataatggtattgctgtttttttttttaaggtcctcatctgttagaaatacaagttggagtattttcagacaaaatgatatgacatctgggacttacattaaaatactccagtacagagggaaaaaaaaggagagtacagatgaacaaagattggcaaaatgttgataattgttgaagcttgttacagaggttcattatcctcttctctgcttctgtgtatgattgaacatttccataataagaattttaaaaaacaaaacttttcaacctaatcttcaaattacactgagtcatccgcactcacaggccggaaatatgataatgaggctttgtgggagggttcagaatgcataaatggagagatggatgaggccgaataagaacaatagctattacttagatagcactgaagtgccaggccttgttctaaggactttacatgcactgtcttttaatccttaacaacaaccttgttagatggtgtatactattatcatcctccttttacagatgaggaaactgaggcacagaaagattgaataacttacacaagtttacacagcttgtgaatggtgaagcagaattccaaacccaggcagtctggctttcgactttttgctctttaacatgatgctagttagatatagaaagcagctgacaggtgaagaaaaggattaattcatccatttacttattcatttatttagtaaatatgtgttgagcctttacaagatggtcacgtaaggatccaggtgctgggggtagagtggtgagaaaaacagacaagtccttgctatcaaagagcttaaagttccatggtgaagatggacttgaaacaataatcacacaaacacttggaaaattacagacatgaagaggtctcagaaggaaaactacaggcaattatgacagcataccatgaggtatctgacccaatctggagggctggaaaaggtttctctgaggaagtagcatttgatctaagagctgaagggtagggaggagttaaccaaacaaaaagggaagggaagggcatttcaggcagagggaatagcatgatcaaaggccctgaggcaggagagggcttgatgtgtatgaaaactaaacaggctaagatggttggagcaagcctagaatgctgagttgaaacggttttttggactccagtctaatgccacaggtaagggaactgccaatgggaaagaaggaagtgaccagtccaaggtcagaccctgaacctgtgacagaaacagtactcaaacctaggtaccttcaatcccaacccagcgttttttccagcacacatcatggcttccctgcatatgaggagggagtgccagcaaaatgttgctcttggggactgagaatggaagagtgtttttgataaccaaatgaagtattcatgcacaaggagatcaaaagtgggtttggggccaagtgtggtggctcacacctgtaatgccagcactttgggaggccgaggtgggaggatcacttgagcccaggagtttgagaccagcctgggcaacatgattcatcagacaaaaaacacaaaaattagctgtgtgtggtggtgtgtgctgtagtcctagctacttgggaggctgagatgggagaatcttttgagcccaggagttcgaggctgcagtaagcagagtcacaccactgtactccagcccgagtgacagagtgagatcctgtcaaaaaaaaaaaaaaaaaaaaaaaaaaaaaaaggagccgagagtgggtttggggcaggaaaaaagatgaaattgattagaaacagtaataatgtatttatgagacagggtctcactctgttgcccaggctggagtgcagtggtgtgatctcggctcactgtaacctcagactcctgagctcaagtgatcctccaggctccagcgattctccaacctcagcctctttagcagctaggactacagacatgtgccaccacatccacctaatttttttaatactttgtagagacagagtcttgctatgttgcccaggctgttctccagctcctgggctcaagcgatcctcccgcctcagcctctcaaagtgctaggattacaggtgtgagccaccaagctctgccaacagtaagaatttgtgtttcccagatacctaattaggcttctcccaccccatttctagctagggttcttataaagtaggtgggatttgggggtaggggatagaagattgagactgagggtttaatctcccaggggaagcaggaaggaggaggaaagccatgggatggaggctgccccagccaacagtcatctccagctctgccagcagagggagccagaaactgaatttcctaagaatggcagctggcctggcccctgggatggataaacccttcttggaaactaatcaagtcagcccaggatgctgtggaaatgacagggactgggaggaagggagggagccaagagttaggattacctgcagggtctttgccctaagtttcacagtctttgatgaaagccttctaaacctgcctttcggggtttgggtgaagtgggcaccaaaggatagagaaacctttgacaaggcagtcccactgcacaaaacatggcatcctccactccctttgggttacctcagtggctctcaaggcctcacaattctgtctctagcctcatcgtctctcctgagatttggacctagatggcaaaatggctataggacatgtcaccccggaagctcaaactcaacatggcaccgaactcaccctctctcccctagacctgctctctcaatatttcccatctccatgaatggcactaccaacccccaaagtggtccaagtcagaaaccgggaagtgtctttgaggcctgcctcatatttgcccctcaagttcaattcatcagtgagtcgtgttggctctacctctaaaatacatcccaaatccaatcacttctctccatctccactgccaccacggtagtctatgccaccattctgtctcacttggacgactgcactagcctcctggcttgtcttcctgcttctatttgtgcctttcccccactatctgatctctacccaaaaaccagaatcatctttcaaaaataccaaactgatcatgccatggccctgtctaaatccttcaaagccccctcgtttccctcaagatcaagtcctgcctccttaccatggcttacaaggccttcctgatctggcctctgactacctctctggccacgtcttacttcttcacaacccctacacatacatgcacacgatctcttctcaaactgaacaacttccagctattcagatcttgcctccaggcctccccacatgcagtttcctctgcctggactcacccttttcacctcactattgtctattcactcctcttgtctcagtgcaggtctccctgcttccaggaaccttccctgatccttctcaacaagtcatcctctgtgatcccacatcctgcctttatcattgggtttattccatggaatgtagctgcctggttacctgtctggctcccccgtgatcatgtgagctctgtgaagaacatttctgtctttttcacagttataccctcgcagagctcagaatggtccctacacataatggctgaccagtaaatagttgttggatggatggatggatggatggatgatctgtcaattagtaatcctaaaggagagcactgtgtgctctgttagagaactagaatgaggccttgggtgggaatgatatatccaaagacataatgaggaccagaaatcagggaagtggggagggccaagcatacccatcccagccacttctcttgccaatactacccctgtctcccttttatacctgcctccagatggacctggaagtaacacagaggattctgagttacacccaggaactagacagccctcttctagtcccttcccagatcttgtgctaggacaaagccacccatgcttggctgtgagatgaacaggctccagccagagcccagtgtcgctggactctccagatgccctgtacccacttgttccccaagtcaaggacatttctgggagctccccatgagctctcctgtagcttccttatcctccttctgcagcagcagagaaaccctccctacatagcatgggtgcctctcacaaaacctggggtcaaggcttctccctggtgccagcccaagaagggactccaagtgggcatctaatccaaataggcgtggcctttttcccttcctctttggcactaaaagagacaggtagtaaaaactacaagctcttgagggcaacaggagggaagtgggggcaaaggtgaagtttttctacagcccttcaaaggtcttggccccttgcccagatccaagtcaagaactgtttgtttcagagaactggcttcccagccatctgctcagagcttaaagagcctaggggccctcatgggatgttctgttcaaattagccaaaaaaggcagggtgaagacaacacagcaggaggggccttgaccagtctgggcctctgaaggtgtggaaggaaggggcaggtatatggcactagggcacattgagggtatggcaagtcccagaacagagagctcttctcacagcccagttccactgatcttagaaccatgtcttccatcctttgtgagcagctaatttatgccaggaactttccccacaacaaacaagatgttctcttgtaccagttgaaggaaccaaggattagagaggttaattgccttgcacgaggtcatgcagcaagtacacagcaggttcaatgagtgtcctctggtgattggttgccaaggctgctagaaaatgattcttcccttcagtgagcagataggcagcctgaggataatagccaggaggggatacagaaagtcacactccttttgcgcctaggacatagcttgctccatccagaaaaaaaaaaaaaaaaaaaaaaaaaaaaaaaaaaaaaaaaaaaaatgtccttattcctttgacacacactgtctctgggttgtagaaatgggtcaggcactaaggtcaggttttacatgtggaaaatcttagggtgaagacaggaaaagactttctcacagtcagagtgtaagagaacagttcagatgaatggagctgtccaagaagccaggcagatatgcaggagaaagactgacaaggaaaccctctctcctaaaatcccccacagccatgaacattcacatgaattgaaaaaccaatcctcagccaggtgcagtggctcatgcctgtaatcccatcactttgggaggccaaggcggtggatcacctgaggtcaggagttcaagaccagccaggccaacatagtgaaaccctgtctctactaaaaatacaaaaattagccaggcgtggtggtgcacacctgtgattccagctactccagaggctgagtcaggagaatctcttgaacccaggaggcagaggttgcagtgaactgagattgcgccactgcactccagcctgggtgacagagcaagactccatctcaaaaaaagaaaagaaaaagaaaaaaaaaaaccaatcctcaggcaaaattgctagggggtaagtttgaggacttgcaaaagtagggggcctttggggccaatctttagttcaccaggggttctcaagtctgcattcatgtgagactcactggggatatcttaaataataattatgtttgcgatatatttatctgacaaaagactgatacccagaatatataaagagctcctacaaatcaataataaaatgaccacccaaaaatatgagcaaaagagtggaacagacacctcatgagacaggatatatgaatggtcagtaagcacatgaaaagatgatcaacataattttccattagggaaatgcaatttaaaactaaaaggacatgcctctacatacccatgagaatggctataatttaaaagacagacaataccaagtgttagcaaagatatggaacaactgtaagtctcatcttttgctggtgggggtgtaaattggtacaaccactttggaaaccagcagtttcaaataaagttaaacccaggaattccactccaagagaaatgagtatatgtgctcacagagagacttgtacaagaatgttgatagcagctttgtttctaatagccaaaaactgggaccaatgcaaatgtccctggatgcctgaatggataaactttggtgtatccatacaagggaataccactcagccacaaaaagaaatgaactactgatcctcagggcagtaggatgaacctcaagggcattatactaagagaaataaggcaatctcagaatgttacatactgcttgattccatttctatgaagttcaagaacaatcaaaatgaatctatgatagaaatcagaacagtgtctgcctctggcaggggtgaagggcagtgactggagaaatggaaatgttctatgttttaatggggcagtggttacacaagcacccacaatatcacaattcactgaactatacatttaaggcctatgcattttactgtgggtaaattatgcctaaattttaagactcatgcccaggcctcacccctaattaaatcaaagtatctaaaggtggggcctgggcaagggcattttcaaaatctcctcaggtgatgctaatgtgcagccgggggtgagaaccgctgataacattaccaccacctttccctggcaacagtccctctcagcctcctgtgttctggagacttttcagagatgcccatcagaaaaagtctctcccactatcacaagcagaggtaggcaagtggggatagaaggcgagtgagggtaagtgcataccaatatatctcaaaggttgtttcatatcaaaacataaaggcactgaattttacactttaaaatagttaaaatggtcaattttatgttatgtaaatttcatctcaatttttcaagttaaaaaaaaaatcagccgggcatggtggtacgtgcctatagtcccagctactcaggtggctaaggtgagagaatcacttgatcccaggagttcaagaccagcctgggcaacacagtgagaccctatctcaaaaaacaaaaaaatgaccaagaacttccttagatttgatggctgcacatattccattgtaaaggtgtactttatttaatcagtcctctattgaaggatatttttcccaatcttttgctgttaaaaacatagtgagagctaggcatggtagctcacacctgtaatcctagcactttgggaggcagaggtgggaggattgcttgagctctagagtttgagaccacactgggcaacataatgagacccgtctctacgaaaaataaaaataaataaaaacatagtgacaataaatattctggtatatggtttttttttttttttttttttgagagggagtctcactctgtcacccaggctggagtgcagtgccgcaatctcggctcactgcaacctccacctccagggttcaagcaattctcctgcctcagcctcccaagtagctggaattacaggtgcccaccaccacgcctggctaatttttgtatttttagtagatatgggggttttgtcatgttgccaggctggtcttgaactcctgaccacaggtgatcctcccacctccatctcccaaagtgctgggattacaggcatgagccaccacgcccggcctggtacatgcatttttttaaaaaatatgtgtgagtgggccgggtgcggtggctcacgcctgtaatcccagcactttgggaggcagaggcgggcggatcacaaggtcaggagatcgagaccatcctggctaacacagtgaaaccccgtctctactaaaaatacaaaaaaaaaaaattacccgggcgtggtggcgggcgcctgtagtcccagctactcgggaggctgaggcaggagaatggcctgaactcgggaggtggagcttgcagtgagccaagattgtgccactgcactccagcctgggcgacacagcgagactctgtctcaaaaaaaaaaaaatatgtgtgagtgtatctgtagaataatttcctaaaattggaattgttgggtcaaagtgtatatgtctttcttattttgctagaaactgccaaattgccctacataagggataaatgaatttacattcccataaacaatatatgaaagtgtgtgttttccccacctttgctaacagtgttttccaaccttttgatcttcacccctctgattattaaaaagtggtaccttgtagttttattttgcattttccctgagagtaagtcttaactgactcagataaagacgttcaagtggaggagaggggtgtttttttcgaggtagggaagaaggcagctgttttagttctggctgctataacagaataccatagactgagtggtttaaacaacaaacatggctgggtgcaggaagctcatgcctgtaatctcagcactttgggaggctgaagtgggaggctgaagtggactcacttgagtccgggagttcggggctgcaatgagctatgattgcaccaatgtactccagcctgggtgacagtgtgagaccctgtctctaaaaaaaaccaaaaaattaaaaataaaataaaaaaaacaaacgaacatttatttctcagttctggaggctgggaaatccaggatcaaggtgcaggcaaattcagtgtctggtgaggccctcttcctggtttgcagacattcaccttcttgttgtactctcacttgagggagaacagagagaaaaaggaaacaagctcttggagtcttttctttttaataaaaaaaatttttttttgagagacagggtcttgctctgtcacccaggctggaatacagtggcacaatcacggttcactgtagcctcaacctcctggtctccaagcctagctatttttattttttattttttcgtagaggtgggttcttgccatcttgctcaggctggtcttgaactcctggcctcaaatgatcctctcataggcatgagccacttagtgcctggcctccaggtcttttcttttcttttttttttgagacagagtctcgctctgtcacccaggctgaagtgcagttgtgcaatctcagctcactgcaacccctgcctcctgggttgaagcaattctcctgcctcagcctcagcctcccaagtaactgggattacaggcacgcgccaccacactcagttaatttttgtatttttagtagagacagggtttcaccatgttggccaggctggtctcgaactcctggcctcaagtgatctgcccgccttggcctcccaaagtgctgggattacaggcgtgagccaccgcgcccggtccctccaggtcttttcttataagacattaatcctattcatgagggcttcaccttcatgacctaatcacctatcaaaggccccacctcctaataccatcccgttttgggttagaatttcaacatacgcctttagcagggacacaacgcatggttcataacagcaggtatcttaccatgtttctgttatagttgtgttagctttgagcaagtcaccaagaatccaagggctcttaactgaatattaaggacacccaaatgtctttcttaggtccaaacctctcactggagtcccagactcctatatcaagtccccctcgacatctgacatttcactctgaaaacgtccaaaagagaattattggttcccaacccaccctcaaacttgacctgccctggttttccccagctctacaaacggcaccactcagttgctcaaaccaaaaaccttgaaattagaaacatcatctctttccctcatccagttcatcaccaagccctgttggctgtctccaaaatacatcctgaatctctccacctatccccactccactgcaactacccaagcctaagccacctggaatttaccaatggtttcctaactagtctccctattcccattcctgttccccagtcaatctttcttattagaaaatcaggccgggcacggtggctcacgcctgtaatcccagcactttgggaggctgaggcagctggattgcctgaggtcaggagttcgagaccagcctgaccaatacggtgaaaccccatttctactaaaaatacaaaaattagccaggcgtggtggtgtgcgcctgtagtcccagctactgggaggctgaggcaggagaactgcttgaacccgggaggcggagattgcagtgagccgagatcacaccactgcactccagcctgggcgacagagcaacactccatctcaaaaaaagaaaaagaaaaaagaaaatcaacgcggggcgtggtggctcatactgtaatcccagcactttggcaagctgaagtgggaggatcacttgagccctggagttcaagaccagcctgggtgacatagtgagacaccatctctacaaaaaaaaaaacaaaagaaaacaaaacaaaacaaaaaacaactagcttggcatggtgctgcatgcctgtagtcctaggtagatgggaggctgaggtgggaagatcacttgagcttggaaggttgagacttcaatgagtcatgatcatgccactgcactccagcctgagcaacagagtgaaaccctgtcttaaaaaaagaaaaaaaataaaagaaaaagaaaagaaaagaaaagaaaatccattcctcaaacagtacccaataatcctttcaagaaacacataaagcagatcaggtcactcctttgcttaagacctttcattgagttcacaacacactggaaatactatcgaaactcctcactgaagcctacaggtccctgtgtgatttccaaatctcaccctttttcttcaggcacattggccttctttctgttctttgaacaaccatgcccatttccaccaccaggtctttgcttttgctgtccccttggccagtaacactttcccctaaaatctgagcatggctggctccttcttatcattcagaaatcagccatctctcctgagaccttccctgacccaccttctttaaagtagctacccccaccactctaatcctatttatatatttcagagcccataccacgatttaaaagtatctgtttccctgtttacttccatgttgtttgtttctcctgtagatatcagctccatgtctgtattttcaaaagccgcaatcgtcctagcacatagtaggtgctgaaaaaatatttggaattaatgaatagtttaacagtactttcttgttttcaaagccttcacctggtaaggatctcagatttggggagaggaagggttgtttttcaagtccctgaaggaaacaaagctgattttaaaaacttgagatctgtgtctatccaaataattagcaaaaagtctgatctattcgtgaactaagctctccttgacctgctgagctgcctttgaaatatcctgtgtcattgcaggcaataaaacagcctttctttgtcaatattctctgcttcaaatttctcactaattccagctggcctcatcccagccaatctgaatgactgaaaggcagagtgaatataatttaatcagcggctctgcccctgcaggatgagcttgaggtgtctctgtgggcctcatctccaaaaggtgtcccaggggctgtgattttgcacggaataaaggagggccagcaggaaccccgctctggcgggggattcaggcaggcaccggctcagggcgggggtccggggaggtgggaggagtcggggtggcggcgaggcgggtgggggcagagccgcagaaaggcagggagaaggggaaaagaagacaataccgggaaaaagaatagtcgtggtaataatagtccattggcggatcgcttgagcccaggaggtcgaggctgcagtgagccatgatcacgccactgaactccagcctgggcgacagagcaagaccccatctctaaaaataataataataataataataataataatagtaataataataatcattgtaatgccagctggccgccgttttagtttacaaactcttcaagccattatctcgtttatgcctgtcaacagcttgcttgcaggttctcatccccgtgtcaccgacagggaaatcaaggctcagacaggtggcggctgagaaggctgcggcctccctgccgcgtggtgccctcggcctttcctgccgccttcccgcccctcttcccgcccacggcgcaccgctcccccacctgatctcctgccatcagtgagcccggcggcgcccggccgttgctatggcatttctggagtgtcagaagtgcccaggaagcatacaaatcgacctgcgtgagacagctctgtgcaaaacaacttccaatttactcgcaataattaccacccccagataatagcctgtactcaggcgggcgagcagggggcggatgggggaagggagagaggactctgagaggcagggaaggaggccgggcacaacagacaaacagccacggcaaggctggggtttcagggagaggtgggggaaagcagagaggtggtgctcctgaattagggactgaagaaggctcagtcctcctaatttggttctggaaactccaacgttcttctggacggatcatatgaaggcatttcattcgatatttactgggcacctttggaggtgggcactttgccgggcaccgggaatgcaaaggcgaagactccaagttcttgtagtgaagtggctcacagactcctgggagagtcaaacataaagggccatgattcattcaagcaatacttactaagcacctactatatgtcaggtattgtgttgaggaaaaaccggagagcaaaacacacaaaaatccttgccctcatgaagtttaacttagagtaggggcagacaacacatttttaaaaaatagccaaagtactgttagttggtgtgttccagagaaatcaaaccaacaggatctctagatttatacacatatgtgacatacatgtatatatttactataaggaattggctcacatgattatgcaggctgagaacaagttctgcagttggcaagctggagacccaggagagccaaggtatagctccaatttgaagatggatgtcccagctcaaagtcggcagagaaaaagaattcttccttactcagccttttattgtattcaggccttcaatgaattggatgaagcctgagggcaccctgctttactcagtttaccaattcaaatgtgaatctcaaccagaaacactctcacgacccacccagaaatcatgttgaatcaaatatctgaataccccacagtctagtcaagttgacacataaaattaaccatcacagtcaaaagggagaaaaaaaacaaaacaggagagcaggaatagcaagtgttggtggagtaggtgttgcagattgaaacaggatgatggggagagtttcactgagaacgtatgttttgaatgaagacctgaaacaagtcgggcagcaagccatgcagacttccaagaatgttccaggcaaaagaaacagtaggtacaaaggccctcaggctctggcatgttggaggaatagcaactagtccagggtagctggaacagagcaagggagagaataggaaagagctgggaacagatcatctaggctatataggctgacattaaggacttagactacaaatgaaacaagagtcactgaaggactttgaggtagaaaagtgacatgatagctgggtgttgtggctcacgcctgtaatcccagcactttgggaggccgaggtgggtggatcacgaggtcaggagatcgagaccatcctggctaacacggtgaaaccccgtctctactaaaaatacaaaaaaattagccgggcgtggtggcatgtgcctgtaatcccagctactctggaggctgaggcaggagaatggtttgaatccaggaagcggaggttgcagtgagccgagatcgtgccactgtactccagcctgagtgacagagcgagattctgtctcgaaaaaagaaaagaaaagaaaagaaaagtgacgtgatttgacttgtgttgtaacagaatccctctggcttctgtgtggtgaatagactgtgtggggccggggggagggcgtgatgggcaggggcaaagtcattaggagcactgctaggagcaaaggagcagtagagtaccattgctgtaacccagatgaaagctgattggaacttagaccagggtggcagctagggagatgatgataagtggtggattctggatatattttgaaggtggagccaagagtatttgctgatggattggacatggggtgggaagaaaaacaaaaggagttgaagatgatcaaggaggaaggtgtcttggggcaggcagtgtggtgtgaaacagagagttcaagttcatagggactcgggagttaagttgggctatacccctgcccttcttagctgtatgaccttgggcaagttgctttccatttctgaacctgagattcctcttctgtaggagtacacagggctgttgtgaagatttaatgaggtgattatgtaaaaccccagttccacggctggcacagactaggtgcttcctgagcacttgctgctcccttgaccttccttttctgaggaagctggaaaagcctcgtagcagagctgaggttggaggcagctgggaaggatgagtggggctctgttaggcagaaaagaggtgcatggggctcatccttcacaacaggcaggaggaaatgaagccaatggccaggcaggccttcgtggaagtctcgggttggggaaagctgcaggaggacagggtgtggagactgtggactgtgtgatggaaaggaagtcctgtgcaaggaaaggaaccccaacagagaggcgtgaggagatgagaggtccacctcctgcctccccagctctgccttggatcggccctggcccagaggacctttgaaaccttctgagttaccggatgaagcaggtcataactatggcacacaaaattcccagcatgccgaggagttactgaggtttgtgtttgtgtgaatcacacagcaaacatctgtcttggccactggccagaacagggctccccccacagccacacgcacactgattgcaaacatatggcccccaaggaagagactctccaaaaggcctcgtgaaccatctttgcattctggcctgaatcgccccagcccttactcccttactccttgtacaaaagcatgaatcccctttatatgggactgttagacccacactgaggaaaccctacccccacctccagaaccacaaacactaactcctcacctcatgaggggctctgacatcagaatgcctgggttcccatccagcccatccctattaattgtgtgaacttggaccaggttcttgacctctctgagcctcattttccacctctgcgaagaaggatgtaaatgatacctccatcacaggcttgatgcaaggctcaaatgggattatctgagagtaagactcaggggctctaaaaaatttgggttttaccttgtcccctgcaccccctactcaatactcccactaccattacgtgattcaaaataaaaattataccaaactgtaaagagggtaagaaatgctctataagttcccgccagaaaataaaaaaaatttttttacaaaagggtaagaaagtctaaccaaggtctgctttttcctgtgatgactactttgatggagttatttgaaatctcaattatcatattattttccaaaacacttttgttgtcatccctgctttatgaatgccctaagcatttttagtgagcagttaggccccagagaatatggacttggaaactgtaactggaaacaacacattcttgttggccaggatcagctaacactcaatagagtttactacttttttttttttttttttttgagacggagtttcgctcttgttgcccaggctagagtgcaatggcatgatctttgctcactgcaacctctgcctcccaggttcaagtgattctcctgcctcagcctcccaagtagctgggattacaggcgcccaccaccatgcccggctaattttttatatttttagtagaggaggggtttcaccatgttggtcagactggtctcgaactcctcatctcaggtgatccaccagcctcggcctcccaaagtgctgggatttcaggcatgagccaccatgcctggcccagagtttactattaatagtcgccagggagtgttctaatacagtttatcctcacaacaaaacctatgaagttggtacaattattatccccttttacagatgggaaagctgagaatcaggggtgtgaattgacttgcccactatcacagctagtgaatgttggtgggggttttgaacactggtactctggcacagaggccatatccttttttttttttttttttttttttgagacagagtctcgctctattgcccaggctggagtgcagtggtacaatcttggctcaccgcaacctccgcttcctgggttcaagccattctcctgcctcagcctcctgagtagctgggattacaggtgcttgccaccatacctggctaattttttttcttttttttttttagtatagacggggtttcaccatattggccaggctggtcttgaactcctgacctgaagtgatctgcttgcctcagcctcccaaagtgctgggattacaggcagaagccaccgcgcctggcccagaggccatatccttaaccgctatgctgtagtgtctcttcaacagttggatcaaactactgccacacatataagagccttgtattccaaaggggctgggctgggttaagagagtgggattggttgtttgggtagctctccccacagctggagacccagccccaagtcttcatcctagctgcaaagatacgagagtgctcaaattggcagtggtgccgcccggtgtccttccgaggggaggcatctataaatgagacgtttgaatcaaatgttttccaaaggtcctttcagttcaaggagctgaaggcccaactttcccttgggcctgccagctatcttctcctatgggagcaagcaggccctttgcagaccctttcactctgtcctccctcaaatagtggtgtgcatcagggtatccttggcccttgcctatcttacttggaggcatggcacgcctgagagacctcatccctccagggctccagttaccttctttatcctgatgcctagtccagacctctcctctgaggttgagaaccatctctccaactgcctcccaaggccctcctccttagtgtctcccacgtatgtacctcgccctctacctgcagtgtgaactcagtgggtgtctctccccggacctcttccttttttcatgttcttttctacaactggctctgccacctactcatccatttgcttaagccagaattcaggcagtcattctcaagttttccttgctctcactctccacatcccatcagtcaccaaggcctgtcaattttaccccctacaaattgcatgaaaccaatcccttctttccgtccccatggctgtctctctaggccaagccacactacctgagagctgaagtaaaaggcaaaagccttccgcggccctctctgcctctattctctgcttccatgagctgctttcaccgtgcagccagagagagctttttaaattaagcaaaatttagccgggcgcggtggctcatgcctgtaatcccaacactttgggaggccgaggtgggtggatcacctgaggtcaggagttcgagactagcctggacatggtgaaaccctgtctctactaaaaataaaaaaattagccgggcatggtggcaggcacctgcaatcccagctactcgggaggctgaggcagggagaatttcttgaatccgggaggcggaggttgcagtgagccgagacgtgccattgcactccagcttgggtgacagagggagactccgtctcagaaaaaaaaaaaaaaaaaaaccaaaatctgggtgtcgacccccctgtccagaactcatggatgactttatttctgtttggattaagtccaaatttttgtacatgtgtaatgagacctagtgctattaggcaaatcattttacaggatgggttctggagtccctataagcctcgattctaatgtaaggccagccatttcatagcgaatgcgactttcggtatgctttttaacatcttgaatcttcaactttctcatttgcaaagtgggagaacagtacctccctggtagcgttgttgtgagggtgagagaggagagagggcatgtaacctgctcaacttggtgccctgcacctaagcactttaatcacttgctgccaattagacctggttattataaagttgtcagtaccagtaatatgatttattgatttaatcaactaacgattactaattgtgatatgatggatttgttatattgtattataagttattattgtgaggttatgatgatattaatttggattctgtgatgatctctccagcctcgcctctcacaacttcctcccacccctcttcccttgcctttacttgtcatacaccctcattcccaggtgttcttgttttctgccatctctccctggaaagtccttctctccccatcctctgagtcctccagcccccttttatctctctaagtcccttcagatgcttaagtcagctcaaggcaccaattcctctgtgaagccttcccagaccctccccccaagacctgtataggtgtctcttctatgggcctccaagagcacctcgtgcttcccttctcagaccacctatcacaacatatttgtgattatttacttgtcacagtcctggacttaggtcgtcagtttgacaaagagctcttatcactgtattccaagttcttagcgctctgctgagcacgtggttgtggttcgataaatgtttgctgaatgaacaagagatcaacctggcagcattcagcgccccaccccatgacaatctgcccccttcaagggggtctgaggccccgagccaaacctcttcaaagccaaaagctgctgtgtctgccctagaagtatttctgtccttcagttcataaccttctcacttcctgtgggcttagtgaaggtgtgggcatttttcttcaccagtaaaatggcaaataagcccaatttttcagggtcgtggaaattcactgcaaggaggagctctgtaaactgcaaagggctgcatgtagcacttaatgatgatcagacacaataaatgtgttgctctttggctcaactcttgtcaagaccccatgcagacaagggccctcctgtttatacagcattatctctagcaatcaggttacaattgattgacattatcactttctttatgtttggcagattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctcctgggggagacagccaaatagacaattttaatacaatgtggcaaattctatgatgggaagaagagagaaatggtgtgtgtgagtccctcaccttcccagaggtttcccaggggaagcaacgtttcagctgagacctgaaggatggatgacagtccaccagaaaaaagttagtggagcggggacaagcagggttgcagagtggaagaaaaatgttcctgtgagaagaaactgtccaaagagtctgaagagaaaagggaacagggtgaatttgaggccctacaagaaaaacaggagaccattcaacaggagacgcccagggagcaggtggctttgtgggcctgatgtccaagaaagaagtcgtggtggtaaacagagacttgggattgcaagctactgttgtctttctattgaaaaaatagctgagcaccacactagggaggccttgcaaggacagcccaaagaatttgaacttgattctacaggcagtgattttgaacaagaggttttgaagagaacgtgacacacgtcaagctgagctctagggagtgggcagcagcctgcagaagagggactaggctaggagcacagaaagtagcccacggcagaggtagcagaaggaatggaggagtgcccatgtgaggggtactgaggtggcacacttgccagaatcagggcagcctgcttggtctcataccagctggaaccagttcctaccagctcccaagggctaattgttaaactttcaggaattttctcagcattcattaaaaatgaaaaaaagtatcaatattaaaaatatttttgctggacatggtgtctcaggcctgtaatcccagctactcagaaggttgatgcaagagaaacacttgaggctaggagttcaagaccagcctgggcaacatagcacaatcctgcctcttttttgtttgttttgtttttagagacagggtcttgctttgtcacccaggttggagtgcagtggtgcaatcatagctcactgccaccctgaactcctgagctcaagggatcctccttcctcagcctcccaaatagctgggaatacaggcacatacccccttgcctgactaatttttttttttttgagacagagtcttgctctgtcgcccaggctggagtgcagtggcgcgatctcagctcactgcaaactccgcctcccgggttcatgccattctcctgcctcagcctcccgagtagttgggactacaggcgcctgccactgcgcccggctaattttttgtatttttagtagagacagggtttcactgtgttagccaggatggtctcgatctcctgagcttgtgatccgcccaccccggcctcccaaagtgctgggattacaggcgtgagccaccgcgcccagcagcctggctaatttttaaaaaacattttggctgggtgcggtgttgcatgcttgtaatcccaacattttgggagcccgaggtgggcagattgcttaaactcaggagtttgagaccagcctgcacaacatggcaaaaccccgtctctacaaaaaaaaaaaaaaaaaaaaaaaaaaaaattagctgggcatggtggcgtgtgcctgtagtcccagctactcaagaggctgaggtgggaggattgcttgagcccaggaggtcaaggctgcagtgagccgaaatcagtgcagtgagaccccgtctcaagaaaaaaattttttttttttttgtacaggtggggtcttgccatcttacccaggctggttttgaactcctgggctcaagcagtcctcctgccatggcctttccaaagtgctggaattacagggataagccaccatgcccagccaaaaaattcaaaaaaaaaaaaaaaaaaaaaaaaaaaaaagccgggcgcggtggctcacgcctgtaatcccagcactttgggaggctgaggcgggcggatccaggggtcaggagatcgagaccatcctggctaacacggtgaagccccgtctctactaaaaatacaaaaaattagccgggcgtggtggcgggcgcctgtagtcccagctactcgggaggctgaggcaggagaatggcgtgaacccgggaggcggagcttgcagtgagctgagatcacgtcactgcactccagcctgggcgacagagcaagactccgtctcaaaaaaaacaaaaaaaaacaaaaattcaaaaaaaaaaccccacaaaaaacatatatatgtaagttttgacagagcgagactgtctcaaaaaaaaaaggtaataaatactaaaatctcatcacttcctcattattttactacattttactactctctatgatgcccttgaagttattcacacctgctgtatctgcatggtggaaatgctatgtaatggtgtgctacgttcatctcctcccaactccttgttcagtgacatgttggtagcctcaaatcagccatggaaatgggcaaacactacaaatcagaacttggctaattgttttggtgattgtctagtgttaaggaagtgatggagaaaatgtttaaaaatgcaggttaaacttagaagtgtgctgtcactgtagccattacattgtgaattgtacaaaaaaattgccaagggtgatggcatgtgcctgtagtcccaggggtatcacttaagcccaggagttcaaggctgcagggtgttgtgattgtgcctgtgagtagcagggtgcactcccacctgggcaacagagtgagaccttgtctctaaaaattaaaaaaaaagttaaaaattaaggaaatattctttcagtattcaagaactattctccaagtcagcaaagaagctgctcacatcattgacagatgagttgaagttccaacatatatgtctttgttgtttcacttttgtcttatttgttaatgcaaacaaaaatatcaaccaatactctcatgggagctaacattcttttgtcgattgcaaccataaccataggttggctatggatatgagtttggcaaaagtcaataaaagcattctatgagaatcaactggctacatggacttcacaataaagagtttttttaaatttaataatattttatttatttttgagacagagtctcgctttgtcacccaggctggagtacagtggcacgatcttggctcactgcaacctttgcttcctgggttcaagcgattcttgtgcctcagcctcccaagtagctgggaccacaggtgccagccaccatgcccggctaatttttgtatttttagtagagatggggtatggccttgttggccaggctggtctcgaactcccgacctcaggtgatccgcccacctcccaaagtgctggaattacaggtgtgagccactgtgcctggcccctttgggctttaaaattgatctttgtgtttggggaattttccaggctaaacaacctggagcagatgagtggatttcgaatttgggagagaaaagtcctacctgaaaagatagcatcactcttggatagccagtttatgttcaagggaacatggaaattaactccttgggtggagtccctcagacccagcacttgccaacttttggtaccaggaacccgaggtcatgtctgcaatgtactttaaaaacttttttttttccacgacacagccctcaggaggtcctgagaacatgtggccccccaccctcccttttttctcccaagatggagtcttgctctgtcacccaggctggagtacggtggcatgatctcggttcactgcaacctccgcctcctggtttcaagcgattctcttgcctcagccttctgagtagctgggattacaggcgcctgccaccacacctggcttttgtatttttagtggagacaaggtttcaccacgttggccaggctggtctcgaactgctgacctcgcgatctgcctgccttggcctcccaaagtgctgggattacaggcgtgagacaccgcacccagccacccctttctttttttaaaaaacttttgaggccgggagtggtggctcatgcctgtaatcagagcacttcaggaggatgagaagggcggatcacctgaggtcaggagttcgagacagcctggccaatatggtgaaaccgtctctacaaaattacaaaaattagccgggcatgtggctcacgcctgtaatcccagctactcgggaggctgaggcgggagaatcgcttcaatctgggaggtggaggttgcagtgagcagagattgcaccattgcactccagcctgggaaacgggagcgaaagtccatctcaaaaaattctgagacggtctcactctatcacccaggctggaacgcagtggcataatcttagcttactacaaccttcaccttcttggctcaagtgatcctcccacctcagcctcctgtgtagctgtgactagatgccagtgccatcacacccagctaattttttgtatttcttgtagagttggaggggtctccctatgttgcccaggctcgtcttgaactcctgggctcaagagatcctcccaccttggcttcccaaagtgctgggatttcaggcgtgagccatccatgcccggctgcaatttactttcaaagtgttcagaaaaataagatgtttgtgtacatatacaggaatgaaaataaagcaaatatggcaaaatgttaaccattattgaatccagctggtgtctatataggtaatcactgtactgctgtttcaactttcctgtatacttgagaaagttcataatataaactacagtaagaatcagtgcaaagttctgaggcaagagaatgcctcttgtgttcaagaaacatcaaggaggccagtgtggctggaacagattgactcagagggaacaggtagatgaggtgaggccagactgtgagggcctcgcaggttcttatggctgtggctcttagtctgagttgggatagatgggagctcatttaggagcatgagtgaggagtgacctgacctgtcttaaacaggatcccattcggcagctgggttgagactgtaggggtcaagaatggaagccaagagacccgttatgggttggtgctatctataatctagagtgcaggtaagagttgttggtggctcagaccagggtggtagtgatgcaggtgataagtggtctgatattatctgggaggagggcatacactgtgctatttatttgttcctttatatgtttattatgaaaaatctcaaagatatataggagtagagagcgtaatgaatcccctctatccatcgttcaccttcaacattatcagtacatggccatttttatttatttttgagtcagggtcttgctctgttacccaggctggagtgcagtggcaatcatagttcactgtagtctcaaattcctgggctcaagctatcctcccacctcagcctcccaagtagcttcaactataggtgagaaccaacatgctcagctaattttaaaaatttttgtagagatggtggtgtatctctctacattgcccagactggtcttgaactcctggcctcaactcccatcttggcctcccaaagagctgggattacaggcatgaaccattgcacccagacttgaagcaaatttcagattgcttgtcatttcttctgcaaatccttcagtatgtatcctcaaagataaggactctgtaaaaagctgtatgattgtgcaaaattgagcaattatttctaagtatcactaaatatggattctggacatattttgaaggtagagtcaccaggattttctgataaaaggaacaggaatcaaggatgtgtccaaagcttttggctggagcttgatggggacactataaacagactgacaggccagagggaggtatcactcttctctatctggtttagggaaaagaatacaggatttgggtatcaaaaaatcaaaatggctttgtaaactatcaagtactatatatgtcctagctatttgttattcttcttattcaaagctgtgctgcattgtgctgctctgactcagatgtgaggcctagcctgctggaggcacagggatgtaaactaaacccggtgaatttctgctagcttcagtctgtttcatctcaggacttctgtttggctccctgctgagatgatctcaaaggtttccttcagctctaagaatatgaagcaaattggaaggcttaaaaagccttacaaagacacaagctattttatttggaaatttgcagctcatttagatgattcagggcccttgcgctaagtccacttgcctggtattagaatggaaatcttccccactatgggaagttgctagtaaaaaaaaaattcccggccgagtgccgtgctcatgcctgtaatcccagcactttggaaggccaaggtgggcagatcacctgaggctgggtattcaagaccagctggaccaacatggagaaaccccatctctactaaaaacacaaaattagccaggcgtggtggcacatgcctgtaatcccagctactcaggaggctgagacaggagaaacgcttaaacctgggaggcggaggctaccctgggccgagatcacgccattgcactccagcctgggcaacaagagcgaaactctgtctcaaaataaacaaaacaaaaaaatccctgtgctagtttaacaaatacattaaaaaatcacaagtttaaaatgttgaaaagaaatctcccaggctaggctcagtggttcttgcttgtaatcccagcactttgagaggaccacttgagcccaggagtttgagaccagcctgggcaatatagcaagaccccaatctctacaaaaaaacaaaaaattagccaggcatggtggtgtgctcctgtagtcccatctactcagggagctgaggtgggaggatcacttgagcctgggacgtcaaggctgcagtgagtcatatcctgccactgcactccagcctgggtgacaaagtgagatcctgtctccaaaaaataaaataaaataaaataaacaaaaccccacatctccctgtgatacgagaccacagctgaacacaccaattctccagttgtgctgactggctcaccaattaacatctaggaaaccatcatatatgtgaaaggaactctgaggcttctcattttcctccatatttgctttggtcccttagctaaaattcacatttctatcatctgctgagcagagattttagtacctagaaaggtgcaaagtgtagccaaggatgtgttgagtagtgtagcaccaagagcctaccagcattcaggaccctgcatccaggtgactggctggagtcctgccctctggcctttcatagtctcgcctgtctgttttaagacagggtttcactctcacccaggctggagtacagtagcacaataatggctcactgcaacctccattccccaggctccagtgatcttcccacctcagcctcccaaatagctgggaccaaagatgcatgacaccatgcccggctaatttttggtagacaaggttttgccatgttatgcaggctagtttcaaactcctgggctcagtcgatccacctgctttggcctctctcagtgctgggattataggtgtgagtcaccacgcccggctcacctgcctgtttctgaagggcaccataaggttacttctgacctggcctcaacagaacaaggatgagctccattctcttgacaagagaaccattcttaaagcaagatacctggcaagcccacttacacacctttcccatccctgattcaggggggcccagtccctgcagaaattccttttctggcccaggtacagtggctcacacgtgtaatcccagcactttgggaggccaaggtgggaggaccacttgagcccaggaattcaagactggcgtgggcaatgtagcaagaccttctctacagaaacaaattaattaaattaatttggcatcacagtgcgtgcccatagtcccagttactcaggaggctgcggctggaggatcgcttgagcccaggagtttgaagctgcaatgagctatgactgaaccattgcactccagcctgggtgacagagcaagacgctgtctttaaaaaaaaaaaaaaaaaaaaaaaaaaaaaaaaagtgaatgggaccccagccagtcatgctttggcgtctgcaatatgaatggcagagaagccctatgggaccaaatctgggcttcagggacccctgggcatgcctcctttagctgattttctctggcaagaccaagtagtctgctgactcaaagtccaggatgctgccaggggtagagatactgccctaagccacagtgcctctacaggcctcttatccactgctaaaccatacacctgggaaacagggaccatttaacattcccagctaaatatgccaagtgacttcacatgtttatcttaaagatgtccaaaacgcaactgattttctcccctaaacctgtgatggtgggatgattaagcctgagtggtctacagcaagttaagtgcaaggtgctaaatgaaggtgacctgagatacagcatctacaaggcagtacctctcaacacagggcaactttgcttctcagagggcatttagcagtgtctgaagtaatttttgtattacaactcagggggtggggggtgaatatctagtggatagaggctaggaatgttgttaaacattccacaataaacaggacagctgcccacaaattatgtagccccaaatgttaacagtatcaaagttgaaaagccctgctataggtggcaagggaggttttcgtttttaacaggaagacatgctttatagggtaacaggaacaagagagttggttgagagaaggttgaaatcacaaggtaggataattgacactgagactggagggactggattgaggaacaggtgtgtaacagcaggccccatgaagcaggggcacatcttcctgagactggtaagcaagcctgacatgacccgacacatttggacaagcaagaacaagtttatgttctacatctctgtcctctgaaaaacagagttgaggactgcagcggcagctggagaataagggcactaagtccaaggaactgcaatgctttgcaacatcaacagcccatttatgaccacctttaatggcaactggagattttcatcctgcgtttggcaagatgggcacaggagtgggaaaaacagatgagccaggcttgtggatgggctagtgcaatacagactggagaagaaaatgagggcagatttttagaaagccaagggaacttaacagggcagaggggtccactgtgtagagaagttcttggccaagtcaaggcgggggagataaatactccgggatttcttggctctttctactccttggttagttgctgttcctttcccaagtctggtatcttctacttcccaccactaactaagcccagccaataacagactgcctaagcctgcctgagaacttaatcactgttcatgttatacagtaaaatagcaggaaactgaattaaaaaaaaaaacaacccacaaaaccaaaatgctattaatcctgccacaatatttttaattacgtacaaagatctgacatgtcacccagggacccatttcacccactgctctgtttggccgccagtcttttgtctctctcttcagcaatggtgaggcggataccctttcctcggggaagagaaatccatggtttgttgccctggaagagaaaacaagcagaatcaaaacccaccacacaccaactcatagtggcttggcacatgctacatttgtcacctcacttaacagaactgaagcctgtttgtgagagtgcttggcatcagctaggcagttgcaagacacagatgctggttaccaaaagcacccactgcttgggtttctggggctgtcctatgaaactcaccgtatgcccttcagaattaatgtcttagaagtttattgtgcatagcaggcacctaccatttattcaagtgagtcaaagtttagtagtacctaaggctaatcattatgactcagcccagctctgcgtgagtcctatccagaagaggctttgcactaggttcagcagagccagccaggagcctggatgctacaatcccagcagccacctgcatttacatatttcctcagactagagagaaggaaaacccagacttaccttgccaataacaaaaatgttggaaagtcgagtggcaaagctgttgccattggcatctttcacgtgaaccacgtcaaaagatccagggtgcctctctctgttggtgatcacaccaattcttcctaggttagcacctccagtcaccatacacaggttacctaggcaggaagaaataatctgcttcaactcaatataacaaatgacaagcagctcagagatgggtccaaacaaattttattcctcctttccccccatttgaatttcctcatatggaactgctgcctatgctaggactcccgggactctcgtaagaaattttgtggccaggcttggtggctcacacctataatcagttcgagaacagtctgggcaacacagtaagaccctcctctataaaaaacaaacaatttaaagaaaagaaatgagtattctgagcatttgtgcctctggctataaacacacctgggcgattggagcagatggtttttaataaagatacccagaccctgtgcaattcataatgatctaggccttaaagagggtgcccaggtagcacagaggatgcttaccagtgtcgaacttgatgaaatcagtaatcttgccagtctccaaatcaatctgaatggtatcattcaccttgatgaggggatcggggtagcggatggtgcgggcatcatgagtcaccagatgagggattccttttgtgcccacaaagatctttctcactttgcacaacttgtactagaaaaatacaagggttagccacattcaatccatctcacatgtactttttaaccctatacaggaaccatgggttccctaactgctgcagattaattgtgacgctgatcgttctttccaccctcaagtgtatgttgcataaagcccttctctaggctcgtcctcctaacatccaccattgccctccactcctccaatgtaaatgccactccagtttcccaggctctttaagccttatggggccctgggaattcttcccttcaactcaactttatcttaatggctccctgtacatcacgactgagttttgtctcacaaacagcaattacattaccagttcatccaatcaacaaatacttcacatagcatttcaattttggatctctactccctgatatccttgaagtaaatcaaataatcacagatcccactggacgtgccctccagtctgctgttaacaaggctgtgcaaaaggaaattaggagccacatcagtcaattaaattaaccttcatttacagccaataatccaaacagccctaaacttttgtgtaaaaccatcaaaacaaactggattaaataatcaaagactgtaatctttttttaaacctcaaactagtgcctcaaggactgtctgtttcctccatcgacaccttcccctccccaaagtaaagctactcccacaaatggagacatggcaaagggctcctacgtcaggtacccaataaacaagttcccagaaatcattctccttgactcttaagagacaccaggaagtcgcggttcaactggaattcatttctaccacaaaaaaagaaaatctgctgaggaagttaacttcaaatgggggccaattttaggtatccatcaatgccctacagctatcagccagacttttaataacatgacaaaaagttacatgtaagacagaatctcatcgaattgttagctagatatttccaggtatgagattttaactaatcaatacccacctcattgcaagcagcactcgtactcaatgcaggcccttagaacaaagtaactatactgagtaaagacccagcttgcttgccacactcaccttggcctcctcaggtgtaatacgatgtacagcaaagcgacccttggtgtcatagatcagacggaaattctctcccgtcttgtcaatgctgatgacatctgaaatcaagcagtaaccggttactacatacagtgatccccactacctcatgccgagcaacaaccatagctctctacgaaacaaaaagaacccccatgtgcctcccagttctaatccaacaaggattctgaagattaaagatcacggccagatcttcaatatttcaaaaccccatgactgcatgtaaaatttaaaagtgaatcgaaatttagttttgaaaagcgtttcatgattatttgcatgttttttatttaagtaaaaaacagagggaaggtcaggctttgtttctgagacttgacagattacaaaggttagaaaaatgatcaagacagtatttggataccatagggctgccatcaatatgcgtctccagagtatttaaaacttcttacccatgaatccagcagggtaggttatatcagttcggaccttgccatcgattttaatgaaccgctgcatgcaaatcttctttacttcatctcctgtcagggcatacttaagtctgttcctcaggaaaatgatgagggggagacactctctcaacttgtggggaccggtggatggacgaggagcctgtaacgttaaaaatgataatcactgttgggattcactaaagcactcaaacctacctcctagtccaccagatccactaactgaacaccaagaccgtccatattacacccaacttggacttttacacaggaggtgtaaaaagcatccaaaactatttcataccttaaagttttatagcatcttccctgtcagaggaccaggatcattaagaacatgaatcctgagtccatgtaaatgtactatgtggtatgtggaataaatgaggcacaaaaatattaaatcgattggaagtggaggacagctagatagtatagctccttcaagggcagaggaagccaagaatagatattcctcccctagcctggtccccaaatgagtcctgggagacacttaaaaacagtggccacggaaatatttatataagatacttacaaacacaccggtcaatttatccagcatccaatgctttggagctgccacccgcttcagatgcttcttgggaccacgagcctgaaagttttagattgcaatgctgttaatcaggtttcagaacagcttataaaacctagtgtgaaactaaactcttagtttagtttcatcttcagcaaaatgtggacaatattaaagtatagtgttccgataaaacagaaacaaacacagttatttaacaaacaccgtgagatccataagctgcaacaagccttcttattgtaacagagaatattcttggttactatgtttcagaacgtttactgattactatctttcagaaccttgctaaagtgtttccatgttactgtttgaaactgtatctgcttagaggttagggtctttcaagaacaccatactagtgaaacgcacagcaacagaaatgagccaggagtctacctgtgtttctaaagttttcacaatttattaccgtctgtttttgacacgtatggaacaagattctgacatccgcacaaacacatgtgctgctccttcgtacactaaagccaaaagctgacaccaattttactttaaaaagagtaaggaagcctttttaatgctgtgtccagatgcttaccggccacgtatggtaaagtcaggccgtgccaaaaaggcaatgacaaagaaaacctttctccgccgggcacccccagcgcccaccaacctcgggctcgcagtctgagctcctggcccagccgcggctccggcccgggaggaaaagcagcttctcccgggatcaggacgtatggccgggtcagaaaccgaggccttcccaacagcagcaccagatctgcgcctccccaaccctaggccagcgttcgcccttcgccctggagcccgtcccggcctaccacggaggccgtgatcccttcgcctctgcccggccatccccagtaggaatcccgaaacctcgggcagccccggccgggggaggatggaggcggatacgtcctaagagctcgctaactaaacggcttaccatggctgcgttaggcaaggaaagaggacctccgtcttccggtgcgcgtagaaattggggctggagactgcgcgcgccggattttcagctgctccgcccagctcagccctttgctggcgcgccgggactctttcttgccatctgctggtgggaggtcagaagtcccgagttgaggaaccgccgcggaaagagggtgtctcctaagggcgatttcctccctcccctttttccgcccttcctcctcccatatttgctgagcgcctcttgtgtgccttattctgtgctaggtgctgggaatacaaagatgagctacacaacatccctggcctcaaggagagttcaaagtgagcttacttccagtctcacgtacagatgattctacgcctgtaatcccagcactttgggaggccgaggcgggcggatcatgaggtcaggagatcgagaccatcctggctaacacagtgaaaccccgtctatactaaaaaaaaatacaaaaaaattagccgggcatagtggcgggcgcctgtagtcccagctactcgggaagctgaggcaggagaatggcgtgaaccccggaggtggagcttgcagtgagccgagatcgcgccactgcactccagcctgggcgacagagcgagactccgtctcaaaaacaaaacaaaacaaaacaaaacaaagaacttgtatataatcaatagaatacattttaataaatatttaatgttatttcttaaacgtattttgtctgtcccttttttgtgttcccttgagccagccaggcagcccatactgagttgggaagagccaacaacgtttttaaccccctcttgcttctctgcttgaactctgacatcctcccccttgcttcctgtacaacgcatttggcacttatagagactcagggaggagagaggatattagaaatcgtctggttatatctaactaaaatgtagatctgatcctgcttcgaaactgcccttggccctctgtttcctgccgtaagggagcaggtctgaactttatctggctccattgctctctctccccaatcccaaacttcaaagctcaagccccaccaagctagtttgttccgagggagtcagctctttttgtttgtttgtttgggagacagggtctcactctgtcacccaggctgtagtgcatggctcactgcagcctcgacagacagcccgggctcaagcgatcctctcacttcagcccccacgagtagctgggacaacaggcgcacgccactgcacccaactaattttttgtagttttatttttttgtagagacggggtttcgccatgttacctaggctggtctcaaactcctggactcaagcgatccgcccgcctcgacctcccaaagtgctgggattacaggcctgagccactgcgcctggctagagtcagctctttcaagactgcttgtggactcgattccttagcttggaactgccacaaacagccaaacccccttcctgggtaccacctaatcccacacctcagccttggaaatgcacagttcaagtccctctggttctgtgggctcgtggtcccctcagtcagggtaaatccctcattcttgccccagaggcttgtgttcaaacttggtgagggcacacagcacattaggtagcaaggacaaatttagttacctggcctccaccaaactgagcacctccaggatggagcctgccctaattcatctgggcaggccccttgccactgaacagagagctcggcactgtgtccagcacttgataaatacttgttgaatgaataaacggagtcagcatcccacttattgtgccaagtcctactgtactatccctgagagcatccagcctgtgcctgaattcttcccaccatgagatcaagctcctaactcatgaggttccatttcacaagtctctatctgtaccatccactttacccctcagcagtctgcagaggagcaagagagggaaacattgttggctcttctcaagcagacagtattaaccaagcagacagtattaactaagagggcaggaactcctccttgtctaaaactgggatacaatccacaataaagcatgttataagtgattattggaaaggatcgattaattggaggtgaggagtagagagaaggtgaaggtgatgagataatggaagttggttctgaggtttttaatctgagagcactgggaagatggtggtacaattaacagaaatggtggagaagttgctgtgggagtggggggataaccatgtgctttccagctagagaggataggagaaatggctggttagagctgcagatctcacttaatcaagatcacacagcccgtttggggatgaggggacttgtctcttgcctcccaggtgagtggtttgtttttatgccataggttatcaaaggacttgaggaaatcaaagcatctttttcagtatatttctctctctcaatttgtatttatgcacaaatgacattctaacaacaataaaggaaatttggaaagagctaagtaaatcgcaaacagtacctccccaaacaccctaaacacatcatctgtattcatttgttcctcttcctgttctctttctgatcggcttgtgtgcatgcatacttttacataattttagtcctagcatacagaccattttgtattctgtttttattatattagaaacactttccaagttgctgcataatcctcataattactactttaacagctgtatcatattccattaagtggatgtcccacaattaatacaagttctctgttgttggacatttagttttctgtactttttctctattatgcgtgttgctacagtgaacagctttttccttcagttgaatattttccttagaataaatctattccttcaaccaacacttattgagtgcttactctgtgtcaagctctgcattatgaactgaggatgcagagattattaagatctagttcttgctctcaaggaacaaataataatatgagaagcaggctgcgggggtggggagggaaagctaggagaagcttatcggagaaaaaaatggtggtgaagcgggttgtaatacagagggcagctaaatctttaggatcttggactttagcctgtgggtagacaatggagagctgttgaaagattttaaggaggacagaatcagtgttgtgctttaaaaagataactcaaactcctccacgtagaatggtttgaaggaaatgtgagtggcttggaggacatgggtcaggtctctgtcaacaatacaagcaagaaactgaaggctgctgagacctagatttgtgactctggggctgaggaggagggggctcaaagactcaaaagacattgcagatggagtattggcaggatctgactgggaaatgatgaatgtgcaggggtgagggacaacgaggtaattaggatgactcccaggtttctggcttggtgactcagtgatgcattcaccggaacaaggaggaggcagaggagtgtgcttgaggagaagatgaggagatgagtctgagacacagggctgagggtgcgggggaacatcagcctggagatatcttatagacccagtcctgagctcaggcgcatgatctgggctggagactcagatgtgggagaagtggtgcatctgtgattaattcaggggagtggttggcagtaacccttagaaagagagcactgtgtcaaagagtctgaatccttttgtagtagcatatgtgtattgccaaaaagcctttctcggaggattcttgcaattttactatactcgtgccagcctggtaatcacctatttttaacttttgctaatgtaattattttaatttacactaaaaaatctcaactaggccgggtgcagtggctcatgactgtaatcccagcactttgggaggccaaggcaggcggatcacttgaggtcaaaagttcgagaccagcctggccaacatggtgaaaccccatctctactaaaaatacaaaaaattagcaaggcgtggtggcatgcacctgtaatcccagctactcgggaggctgaggcaggagaatcgcttgaaccctggaggcagaggttgcagtgagctgagatcgtgccactgcactccaacctgggtgacagagtgaaactccatctcaaaaaaaaaaaaagccactagtgaggttgaatattttgccacatgcttgtttactcattccatttcctcttgtgtgaagtatctctggccatttatctttggggacatgttttttgggtagatttccatgaatgctttataaaatatagacattaatcctttgtcataccaattggttattttctttttggttgtacttttcagtgtacaaactttcaggattttatatagccaaatctgttgatcttttctcttgtaatctcttcttgttccttcaaagcttagaaagctgctatcagttcaaagatctattagatactcaattctatttaataacatatatttaattttttattaacttggggttgataaagataaatagaataaatagaaaaaaattatatttccccccaaatgttagctaaccgacattcttactataatatattgaatgatctttcctctgttgttttgtaaaaaccgctttagcatataataaatgaaatcacagagtacatggttctagttctgtaagtgtgggaatgggagatgagtctttgaagagagaactgagacacacgtccccagcatcctgtcccagattactaaggaggatagacgtgtatgagcagttcatggtagtagtgttggaattacaggcctatgccactacatctagccttaaacttatttttaaaacagctttaccagccaggtgcggtggctcatgccagtaatctcagaactttgggaggctgaggtgggcagatcgcttgagcccaggagtttgaaaccagcctgggcaacatagcaagaccccatgtctacaaataaaaataaacaaaattagccaggcatggtggcccacaccagcagtcccagctactctggaggctgaggtgagaggatcaaaaaacaaaacaaacaaaccaaaacacaagctttactgaaaaatacttgacatacaataaatagtaagtgtttaaagtacacaatttgacaattctgatgcatgtatacacccaaagaaaccatcacaactatgatagtgaacatgtctatcaccaacaaaagtttcctcatgtgcctttgtaatccctcactccagcccctcccatccccactcctattcccaggcaactgctgatctgctttctctgactattgatgagtttgcattttttagatttttaaataatagaaataaatagaaatcaaacagtatgtactcattttggtctagtgtctttcactcagcataattattttgaggctcatctatgttgttgcgtgtatcaatagtttagcttcttctttttattgctgactagtactccattgtatggataaacattaattatttacccatgatagacatgtgggttgtttccagtttggggcaattaccacaatgctgctatgaatgttcacatacgagtatttttatggacaatgttttcatttctctcgggcaaataactaagagtggaatggctaggtcatatggtaggtgcatatttaacttttataaaaattgccaaaatgtttttcaaagtggcttgtgtcatgttacactcccatcagcagtgtatgagaatttcagtcgctccacatccttgtcaacgcatattaaggcccatctttagaaaacatttttattgtgatgaaatatacataacatttttttgaggcctggtgcagtggctcatgcctataattccagcactttgggaggccgaagcaggcagatcatgaggtcaggagttcgagaccaacttgaccaacatggtgaaaccccgtctctactaaaaatacaaacgttagccaggcatggtggtgtgtgcctgtaatcccagttactcaggaggctgaggcaggagaataacttgaacccaggaggtggaggttgcagtgagccaagatcatgccaccgcactccagcctgggagacagagcaagaccccatctcaaataaataaataaataaataaataaataaataaataaataaatttatttgccattttggccattcttacatatacaattccttggcattaagcacattcacaatgctgtgcaatcatcaccactagccagttccagaattttttttattttcccaagcagaaactcagtacccattaaaaaataactccccatttcccatacccttaacccctggtaacctctattcaactttctgtctccatgaatcttctcattctaagtatctcatataggaggaataataaatatttgtccttttgtatctgggttgtttcacttatcagaatatcttcaaggttcatctacattgtagcatgtatcagaatttcatttttatgtctgttaatattccattgtatgcatatgccacattttgtgtatccatgatctgttgatgtacacttgggttgtttccatgttttggctattgtgtataatgctgctatgaatgttggtatacaagtatcaatttgagtttctgctttcaattcttttggatataaacccagaagtggaattgctggatcatatggtaattgtatgcttaagtttttgaggaactgccagactcagtggctgcattatttcacatttcccccagcaatgcacagggttccgaatttctccatgtgctcaccaacacttgttattttccatttttgtttttcataattgccatactaacgggtatgaaatggtattgcattgtggttttggtttgtatttccctaatgaatgatgttgagcatcttttcttgtgtttattggccatttatattatactttctttggagaaatatctattaaagtgctttgcccatctttaagctgtttctttttaattggtgttgttgagttttaggagttctttatatattctggacattaatcccttatcagatatgatatggtttagctctgtgtccccacccaaatctcatcttgaattatactcccgtaattcccatgtgttgtgggagggtctcagtgggagatcatttgaatcatgggggcagattcccccatactgttctcgtggtagtgaatatgtctcacgagatctgatggttttatcaggggtttccgcttttgcatcttcctcatttttcccttgccacccgccatgattctgaggcctccccagccatgtggaactctaagtccaattaaacctctttttcttcccagtctcaggtatgtctttatcagcaatgtgaaaatggactaatacaagatatttgatttgcaaatattttcttccattctgtgggtttttttcctccactctcaagtcctttgatgcacaaaagttttacattttgataacgccccatttatctttttcttttgttgtctgtgaaggtcagtctttggcaatttgaacacatacgtagtactatcttattgtggttatactttgcatttccttcacggctaataatgcttaaaatattttcatgtgcttttttttttttctcctatgtatcttctttggtgaaatatctgttgaaatgatttgcccagttttcaaaactgggctgtttatcttcttcttattgcatttgagagttgtttatatattctgggtgcaaatcctttttttaaaaggctagtcaagtgaagcagtaagagtggagaaggaacaaaggaatctgtaactggttatgatcaattagttgtgaatatcactgcactcggactaccatggaagcaaatcctgtatcatgtgatttgcaagtattttcttcaagtctgtggtggtttgttttcattttttaaagtgtctttttttttttttgagacagagtctcactctgtcacccaggctggagtgcaatggcaccatgtcagctcactgcaacctccacttcccaggttcaactgattcttttgcttcagcctccgaagtagctgggattacaggcgtgcaccaccatacctggctaatttttgtatttttcgtagagatggggtttcaccatgttggccaggctggtcttgaactcctgacctcaggtgatctgcctgcctcagcctcccaaagtgctgggattacaggcatgagccaccgcacccagcctgaagtgtctttcaaagagcagaagtacttaattatgatgaagtccaatttatccatttttttctcatattgattttgcttttggcatggtatgtaagaaatctttgtctaatctaaagtcacagagatctcctataatttcttctggaaatttaataattctagattgtacatttaggtctacaatccatttttgtgttaacttttgtatataatgatgggtgtggatagaggttcattttattatttatggataattgttttagaatcattgttgaaaagacagttcacttctgaccatttaatgatacttccttattataggaaaaattcattttaatcgcataagttggagatgaatatgttcttgtaaaatataaaatcatttttgaccactttcacagccgatcgtgctttctcctgcacgtcctatcaggtaacaactctaacaacatccctatgaagtgaatctttccggatttttttctatgcatggatatatgtatccatatatacaatattgtacattttattttgtttagataggatcaccccatatgtattattctgcaactatgtttttgttacataatagcacctctcagagatctttccttgtcaaaacatagagatctacttaattctgtttagctgtttcgtagtactgtattccatagtaccactatatcttactttgttttaccgtctcctttttaaaaacatttttattttttttgagatggagtcttgttctgtcacctaggctggagtgcagtggcgcgatcttggctcacagcaacctctgcctcctgggttcaagcgattctcctgcctcagcctccccagtagctcctggctaatttttgtgttttagtagagacagggtttcaccatgttgcccaggctggtctcgaactcctgagttcaggcaacccacctgccttggactcccagtgttaggattacaggcgtgagccaccgcacctggccccatctccttattgatggatatctaggttatttcctttttttttttttttttttttttgagacggagtctccctgtcgcccaagctggagtgcagtggcgcgatctcggctcactgcaggctccgccccccggggttcacgccattctcctgcctcagcctcccgagtagctggggctacaggcgcccgctacctcgcccggctaattttttgtatttttagtagagacagggtttcactgtgttagccaggatggtctcgatctcctgaccacgtgatccacccgcctccgcctcccaaagtgctgggattacaggcgtgagccaccgcgcccggcccttttttttctactattataaacaatgctgaacatctctgagtctacttttggtgcacatgtgcaagtgtttctctaggtagatactgaaaagtgagatttatgcagcaaacacatttataacattttaatgctaagtgctgtttttaaatgttttacgtatgttcattcatttaatcttcacagcaacctcatggttttgtccttgaggacagatgaggaaactaaggcgcagagaagcaacttgtcagaggtcacacagctagtcaatagcaaggtcaggatttgaacccagatagacaggctctagagtgaagtttgctgggttatagggcataggcattttaattttttttttttttgagacagcatattgctctgttgcccaggctggagtgcagtggcgtgatctcagatcactgcaacctccacctcccaggttcaagcagttctcgtgcctcagtctcctgagtagttaggattacaggcatgcaccccatgcctggctaatttttgtatttttagtatagaccgggttttgccatgttggccagactgatctcgaactcctgactgcaagtgatccacctgtctctcttcccaaagcgctgggattacaggcgtgagccaccgcgcccggctggcatttttaattttaaaggacctgccaaattgacctctaaagaggctgtaataagttgcactctcacgagcagtgtatgagagtattaatttcccttcaccctctccaacaatttaatcttttaaaatagcattttttgtggttattaataacaatgtgtaatgacactaatatttttgcacttgatcttaaccaaaaggctgagaagtgatacactaatatttttgaactcttactacatcctagctaaagtttctatgctttctctttcatctcactttgctttacttttcctcatactacaatctgctgatatatattaatttctatctttgtttatttcctctcttacccattagaatgtcagctctataagagcaaagattttgggccaggcacgagggctcacatctgtaatccagcactttgggaggctgaggcaggaggattgtttgagttcaggagttcaagaccagccttggcaacatggtgaaacctcatctacactaaaaatacaaaaaattaaccaggcatggcagtgtgtgcctgtagtccctgctacattggaggctgaagtgagaggatcccttgagcctgtgaggttgaggctgcagtgagccatgattgctccagcctgggtgacagagcaagaccctatctcaaaaaaaaaaaaaaaaaaagattttgtttgtcttgttcactgctatcctcggcacctggaactaaatgtttattgactaactgaataaatgaatttgaaaaccattttacacatgaggaaatcaaggctcagagagattaagcaactcacccaaagtcacactagcacatggtggagctgagtttagaagccaatgtagttccagggcttatttgtgctcttaaccatttagtctccagttgatatggtttggctgtgtcaccacccaaatctcaactttaattgtatcttccagaattctcacatgttgtgggagggacccagggggaggtaactgaatcatgggggccagtctttcccgtgctattctcgtgatagtgggtaagtttcaggagatccaatgggtttatcaggggtttctgcttttgcttcttcctcattttctcttgctgctgccatctaagaagtgccttttgccttctgccatgaatctgaggcctcccaagccatgtgtaactgtaagtccaattaaacctctttttcttcccagtcttgggtatgcctttattagcagcgtgaaaacgatctaataggccgggcgcggtggctcacgcctgtaatcccagcactttgggaggccgagacgggcggatcacgaggtcaggagatcgagaccatcctggctaacacggtgaaaccctgtctctactaaaaatacaaagaattagccgggcgtggtggcgggtgcctgtagtcccagctactcaggaggcagaggcaggagaatggcgtgaacccaggaggcagagcttgcagtgacccgagatcacgccactgcacaccagcctgggcaacacagtgagactctgtctcaaaaaaaaaaaaaaaaaaaaaaaaaaggaaccgaactaatacacctgtgatctgttttccactcctataattacgctatttcatgaatgttacataaacaaagtcataaaatatgtctcctttagattttggctggtttttactcaggataatttcctttatgttaattctttttttatcgctgaatagtattccatggtatggctgtaccaccatttgtgtgacccatggaagcatatctgggtggtctccagtttgggactcttaggaataaagatgctaggaacatttgtgtacaggtttttgtgtagacataagtttttatttcactgaggtcagtgtccaagagtgtaatttctggattgtatggtaagtgcatgtttagttttataaataactgccaaattctatgccacagtggctgtaccatttcacattcctactggtaatgtacaggtcatccaatttctctgcatccttgccagcatctggtgttgtcagtactttttattttagccattctgataagtgtgtagtgatatattattgtggttttatctccctaatagctacatggtgttgaacaccttttcatatacttatttgctatctatatatcctcttcagtgaaatgtctgtgcatgtgttttgcccattttctaaatggatttttttttttttttgagacagggtcttgctctgttccccaggctggagtgcagtggcacaattatggctcactgcagtctcaaactcctggactcaatcagtcctcccatctcagctagaactacaggtgtgcaccaccatgcctggctaattatttttatttaaaaaaaaatttgtagagacagagtcttgctatgttgcgcaggctggtcttgagctcctggcctcaagcaatcctcccaccttgacctcccaaagtgctaggattacaggcatttccggccccctcctcctttaaattgcttttgcatctttgtaaaaaatcatttagttatacttatgcgagtctatttctgggatctctattctgttccattgaactatgtctctccttccaccagtatcacatttattgtagctacatagtaagcctgagcatggactagagtgattcctcccactttattcttctctaacaaaattgtcttagccactctagttcctttgcctttccatagaaattttagaataagcttgtgtatgtctacaaagaaccttgctgagagtttcatagaaattgcattaaacctatggatcatttcaggtgttctttgaatttttttcttcggcattttataattttcagcaaacagaccctgaccaggttttatacataagtatacatacatttttagtgatggtgaatggtatcatgtttttattttgttttttatgtgttcattgatagtacaggaatatagaaatgtgattgctttttgtgtgttgatcttgtatcttttgaccttgctgaactcacttattagttctaacagtgtttttgtagattccttgggattttctacatagagcatcatgtctatctgcaaatagagaaagttttctttctgatctgtataacttttatttcctttttttaccttaccgcagcagctgggacttctagtactaggctgaataagaatgatgagagtgtatgttcttatcttgttcccaatcttggaggaaaaacattttgtttttcttcattgagtatgatgctgcctgtggggtttttttgtttgtttgtttgttagtttttggagatggtttttatgagactgaagaaattcccctctattgctggtgtattgagaggtgttttggtttttttttttttttttttttttttttttgagacagagtctcatgttgtcgcccaggctagagtgcagtggtgcaatttcagttcattgcaacctccccctcccaggttcaagtgattctcctgcctcagccacctgagtagcagggattacaggcacccgccaccatgcctggctaatttttatatttttagtagagacggggtttcactatgttggccaggctggtctcaaactctgaacctcaagagatccgcccaccttggcctcccaaagtgctgggattataggcaagagccactgtgactggcctgtattgagagcttttttttttttttttttttttgaggtggagtcttgctccatctggagtgcagtgcgtggctcgatctcagctcaccgcaacctccacctcctggcttcaagtgattctcctgcctctgcctcccgagtagctgggattataggtgtgcatgccaccactcccagctaatttttgtatttttagtagagatggggtttcaccatgttggccagactggtctcaaactcctgacctcaagttatccgcccgcctcagccttccaaagtgctgggattacaggtgtgagccaccacaccccgcctattgagagttttaatcatgatctggtgttgaattttgtcaaatgctttttctgcattaattgatataatcatgtggtttttcttctttagcctgttgatatagtaaattatttccattgagttttgaattttttttgtattttgagacacgggtgttttttgttttttgagacctctggtacccaggctggagtgcaatgatgcaaccacagcttactgcagcctcaaaatcttgggctcaagtgatcctcccgtctcagcctcccaagtagctgggactacaggcaccagaccatcacgcctggctaatttttctgatttgttatagagacgaggtctcaccatgttgcccaggctggtcttgaactcctggcctcaagtgatcttctggccttagcctcctaaaatgctgggattacaggcatgagctaccatgcctggcctcgttttgaatgttgaaccaaccctgcatatctagaataaaccccacttggtcatggtacattattctttttatatattgttggattggatttgatcaaattttgtttagaatttttgcatctaaattcaggagagagagtggtctgtagttatattgttttgtatgttgtttttgtctggttttgatatcaggataatacttgggaagcattccctcttcttttgtgtaaaattggtcctaatccttcttagaatatttcataaaattccccagtgaaaaaattttggcctagagatttcttttctgaaagctctttaattatacaaatccaatttatttaatggttgtagaattattcagattatctatttcatctcggtagagttttgggttttgaagaattgattcatttcttttaagttgttgaatttattagcacaggagtgtttgtggtatttccttatgattcctttaatagctgtaggatctgtagtgatagcctctctttcatttctgatgttggtaatttgtgttttctctttttatttctgtcagtcttgctagaagtttgtcagttttattgactttttttctgaagaaccagctttttgcttcattgattttctttactgttttcctgctttcaatttcatttatttctgctcttatctttattgtttcccccttttctagttggttttggtttattttgcactttttttcttgttttttttacgtaagaatttagattattgactggacttttctggtttttgttttctttttgttttttgtagagatggggtctctttatgctgcctaagcttgtctcaaactcctgggatcaagtgatcctcctgtctttgagtcccaaagtgctgggattacaggggtgagccattgctcctggtcccttttctgttttcgaaatgtaagcatttggtgctataaacttctctgctttacctgcattccacaagttttgatatgtcgtattttcattgtcattcagttcaatatattttttagaaatttcctttgagacttcctttttgacccatggattatttagaaatatgctgttcagttttcaagttttaaaagacttttttgttatctttgttattgatttctagcttgattccattatagccagagaatacattctgtatgatttcacttcttttaaatgtattaaggtttgtttctgaacccgcatatgatccatcttggtcagtgctccatgaatacttggaaagaacgtgtattttctgttgctggataaagtattctataaatgtcaattagatcctcttggttgatggttttgttgagttcttctatatccttgctgaatttgtctagtcattttaccaattgctgagagagggagttgagccctccaactctaactggggatctatctattttgttgttcagctctcttggttttcgcttcatgtattttgaagctctgttgtttgacgcaaacacttaggattgctacgtctttttggtggattgatcctttaaacacgtctcttttgtccttagtaactttctttgctctgaagtctattttatctgatattaatataatcatttttgctttttaaaattaatgtttgtatgatatatcatttttccatccttgtgctttcaacctacctatgttggcatgtttgaagtgagttttctgtagacagcgtatagttgagttgtgctttttagacttttttctttttttttttcagagatggtgtctcgctatgttgcctaggctaggcttgaactcctccttcctcagctggaattacagatgcgcacgaccacacccagctgggtcgggctttttttttttttgggagacactctcactttgccacccaggctggagtgcagtggtgcggtcttggctcactgcaacctcagccttctgggttcaagtgattctcccgcctcagccacccgagtagctgggattacaggtgtgtgcaaccatgcccagataatttttgtatttttagtagagatggggttttgccatgttgggcaggctggtctcaaactcctggcctcatgtgatccacccccgtcgacctcccaaagtgctgagattacaggtgtgagccaccatgcccggccagggttgtgctcttttaaattcactctgcaccaggtgcggtggctcatgcctataatcccagcactttgggaggctgaggtgggtggatcacctgaggtcaggggttcaagacaagcctgaccaatacggggaaaccccgtctctactaaaaatacaaaaaattagccggtcgtggtggcgggcgcctgtagtcccagctactccggaggctgaggcaggagaatggcatgaacccgggaggcggagcttgcagtgagccgagatcgcgccactgcactccagcctgggtgacagagcgagactccgtctcaaaacaaaaaacaaagaacaaaaattagccgggcatgatggcatgtacctgtagtcccagctactagggaggctgagacaggagaattgcttgaacccgggaggcagaggttgcagtgagccgagatcatgccactgcactccagcctgggcgacagagtgtgattccaactcaaaaaaaaaaaaaaaaatgcactctgcttatctctttcttttaattggtatatttagtccattaacattgaaggtaatttttattatgtcagggattcagtctgccattttatattatttgttttttgtttgttctttttttcattctgcttatttttgcttgccttcctgtaatatattttagaatttcatttggatttatttatactgattctgaatatattacttcgtatagttttcctagtggttgctataggtattaccatatatatatatgtgtgtgtacatatatatgtacacacacacacacataatttatcatagccaagtggtgttcaaatgagttcagattgagtaaattctattgatctgtcttcaagtttacagaatctgtcctctgtcatctccactctattattgagtccatccagtgagttttaaaatttcagttatttttttcattccattattccttttagtttttttttttttttttttttttttgagagagagagggtctcactctgtcgcccaggctggagtgcagtggggtgatatcggttcattgcaacctccacctcctggactcctcccacctcagcctcctgagtagctgggaccacaggcatgcaccaccatgtttggctaatttttgtattaattttgtatataaattttatagagttgcattttgtatttctttgtagttgcattttgtattaatttttgtagctgcattttgtattaatttttgtagctgcattttgtattaattttgtatataaatttaattaattttgtatataaatgttgtagagttgcattttgtatttttttgtagagacagggcttcaccatgttgtccaggctgagttctattttaaagtatctatttctttgctgagattttcaatttttcatttatttcaaatgaatttgtaattgattgttgagaagcttaaaggcccttgtcagataattccagcatttgattcatcttgatgttggtatcagttgactgtcttttctcattcaaactgtggttttgctggctcttgttatgatgagtgattttcgattagtatcctgaacattttggtattagcaggtagttaccctacttagcatgtaggttctggtctactttagtgggccagtgacagtttagtcattggccaatgacagtttagttttctgagcccatgcaatgttactttggtcggcttgatttttctgctattcctggggtttctgctcaatccttgctggttctgtctacaggggcagaaggtccttccttctttgagctgcatatttttggtgggtgatcttccaggggagagagttgctgaagccactgtgtgtgagtctccttatgccattgggtggagggaaaggagacacagggctttgttcctgctacctatgcaggcaaattgggttgcctgctggtaccccagttctggagggagccactgagacagcccaggactttgcttgctgctacaagtagattggaccactttctgggggctttagttgtggagcagggcttagatctccccactaggtgtgtgtctggcttcatctttccccgtcctttgtgtgtgcatgcgtgcatgcttgcacgtgtgtgtgcgtgcgtgcatgtgtgtgtgtgtgtatgactgttggttttaggttgcatgcctctttggcacccagtctaggagtatacaggagataaaaagaaaactgaggaagctcaccatgtcctgaagttcctgacctgtctgtcttctttcctgctttcagtgtccttttatcattgcttattgaataatttctagggtatagagttgcatttgaaggagaggagcagtcattttgttccagaatcagaagcccctagtgtagttttaaattacatttcttgtagtgtgagtgaggttgagcatcttttgataagtttttaaaccattttaatttctttttctctatttcattttctgtgaactgttaatatcatttgcctattttcacattgggctgggggtctttgatgtattgatttgtaagagttgttttcgtattcactaggaattgcagatattttctctttttatctcagtttatcttttgactttgactttgactttgtttatggtatgatttttgctttgcaggtttttttgtttgtttgtttatttgtttttttgagacaaagtctcactctgttgcccaggctggagtgcagtggcatggtcatgactcactgcagcctcaacttcctaggtccaagtgatcctcttgcctcagcctcccaagtagttggcaccacaggtgtgcgccaccatgcccagcaaattttaaattttttgtagagacaggatctccctatgttgcttaggttggccttgaactcccaggctcaagcaatcctttcaccttggcctcccaaagtgttgggattacagttgtaagccaccatgcctggcctatttttttaaatgcagttaaatatatcagcctcttccatagcttctgggttttgtgtcattcttagaatggcctccctatttcaaaattttatttttaaaaatctcctttttggtcttctactactttcatgattttaatttttatttttaaatctttggcttatctggaattcattttggtgtaagtttgggttagtgtatccagttgtcccaaagcgtttattgagtaatccattatttcctcactgctttggaatgctaattcttgtttttttttttatttttaattgtggttaaaaccacaacataaaatttaccatcttaaccatttttatgtgtacaatttagtagtgttaagtatattcacattgctgtgcaacagatttctagaactctttcatcttgcagaactgaaactctatacccattaaacaacaactctccattgaaatgttaccattttatcataaactaatttcccatcttctttattcttcctggaccactgtcacagctttctagaatcaccataattccaatttgtcatgcacaccattgcccgattaattttcctcatgcaagctctgacctcaactcttcttcatttaaaaccttcagaggccctctctgacactgcaattgagattaaacccccatgataccctttcattgtgccctgtaccttttcttcctatcacttctcatgatttgtaattttaattatctgcatgatcacttgactactggctatctccttgctaaacttgaagtttcatgagagcaaggacaatgtgcttaccacatattcccagtgcttagcattgttcctggcacaaagtaggtgctcagtccttatttgtggaatgagagattgtcccttacctgtggaataaagtattaacaactgcaggatctgattttaccctacctcctctcggtcctctgctctttgaggaagtcaagctgtgggacttccttgacagaggcttgggttttctaacattttgttctggtttacatcatgccctgattttatctttgtatttgtgctccaattgccccctcatcctggaggccatgccatccactcaagcccccaccagcattgctgcttgatggaaatacagttcatctttcaaggctatggctatctccaccactgagctatgagttcctggaatgcaggaacggggttctctctagtttgtccctagggagcagcactgctcctgggctctaggaggtgctcttggctacacatttgttctgagcagcaagctccttgcgggtagatagtgttctttacttgtgtacatctgggtaccttgcctcctagcccccagggcctattccaggccaggacttggagttggcttcaggaatcttctagtaacctaatgaatgactgcgtctggtgtgaatatgacctctatggcaaggactgagacttgcctgcctttcttccactgtgccttgtgggttcccttactccctctccttctctagcaataaagttactgacccatgccctccacatctgcccctgtgcagggccttgactctcccttcaggatgtcccatgtcttctccctccaagctctctggagaggaggctgctccgttggccacatttctggccactggcaccaggaggcagggttgccatgccaaagttcctgctctccctccccattcagaagcaccttctctaggtttgatgggtaattttgtatgtcaatttgactgggctaaggacattgattgctgatcaaacatttctgtgtgtgtctgagagggtgtttctagaagagatgagcatgtgaatgggtagactgaggacagaagatcaccctcagcaatgtgggtaggcatcatctgatctgttgagggcccaagtagaacaaaaagacagaataagggtgaatttctttctgtctaagctgggacatcattttctcctgtcgttggacctctgtgctcctgtttctcaagccttcagactcagaccaaggcttacaccattactatcctccaccttttcaggccttcagactccgatgaattacaccactggcttgcctggttctccagcttgcagacagaagactgtgggacttctcagcctctataatcttgtgagccaacatatgtatatctgtatatctctatcctatttgttctgtttctctgtagactctggttaatatactagagatgctcaggccattccccaccatcatctgcctcccagccacactcctgtcactcccatgattccaaagcagcccatccccctcctgaaggcactggcccctggctcaagcttctctccaccccaagggctactgccatcctgggggtcccagagcttatactcatagagattaggggtggcaagctggggatcaggcgctgaatgcagcctcctgacctgtttagtttggccagaagtgcgttttttgaaggccccagcaggggagggaccctgggatcctctagcctttcagagttcggctccatccacatcctgtcattctgctttagctgccatgcctgtgtccacactgcccttgtgttgctaggagctgtgcagattctgagaccctccttcacctcccttcctagctcccccaatcttgcccatgtgcaatagatagatagggccgaagaaggatcctatgacctgggaagtcaggtccctccttcctctcccttcctagctcccccaatccagttcctgtgttctcctcagagacccaaggccctcaagcctgctctgctctccccaccttcttccagccttcgtttcttccttttccgttttcctacccttgcctcatcagccccctcaaaaccccatgtctccctgttcccagccttagatgaatctaaccatctacctttattgaaatcatcttaaaaacaagatgttaaaagttggttaattatttgctttcctacaaacctccagagattcttccagagccacaggactggtggcactaaggcgaaggcttgtttccagaaggccctatggactctgccttttgtgaacttctccaacctcatctcctcccgtcccctctgccagccctgtgacatagcctgcatgctgaactcctggttttcagccactgtcacccctctcatgcacctgtgcctgtttaacagctgttcccctcactcattcttcccttggctgattcaagtcttatttcgaaagccaaaactttcttctggtggatctacctttatgtaaggacagagagcaaggccagcaaggatgcaccacaaacagataaacagttgctacctccgtggagaaccagaggcaatcaggattgagggggagatttggtcaaagggtactttagccttatctgcaaagcttctactttttacaaggagattggataatggatttattgcttgtgaaatatgaaaacaaataaagcagttcaatacaaggagccttccccagacttcccaggcagatggagctgtttccttttctgggattgaatagcaccttccccctctgttctaggaaatgctgttttattataatttgtttgtgcctgtctttctccttctgagatgaggaactccctcaaaggtaaacttcatctaattcatgctcccagtgtctagcaaagtgcctggcccagagcaggtgctcagggagtgctgaatccaatcaacgcccctgctagcacactcttttgaaagtgcttgctagggggcaggcctgatgctagtcctgagaggctgattagagtcgttttcagcattcaaggaagaaggctgtctgggagtccgaaacatggacagagtgtccaggacattgggttgtatcaacatgaggacaaggctttatcagtgtatcacaaggccaggatccagtgcagtgccactgccttgccacttggcatgcttctgaagccactgcttcctcagcagttaattgaaaggcaagggatagatcgccaaatgttgaacttgtcaagcctagttctgatctgtatctctaagatggagaggccagctcaaacagggtgggtcaggaaggtaggagttagggacactcaagaccagctcagagtgtcccaggctgggaggactgagcagctatgtgaggaacctggagaaggcacctcaaaccccagtttaatgatgggagtctcttgcttttgcaattttccagagaaatctgagctcccaggtcacaggatccttcttcagccctatctatctattgcacatgggcaagagggcaaaggaaaggccttaatgggtcagttggattggggctagagagtgggtgggggtggcttttacagttggtgaagtgtgtgccacgtggccaggaatgtgcctttagacttggatgtgcatgtagcaaggaggctgcacaaaggtctgatcagtctctcttccaagaaagcccccaaccagcccctgtatgccatggtgttcctggagtcttagggcaatgagaccaggtactcctgaggagatagccacagtggtgctggcagcaggaattcagtgaacagcccccttcaccctcccttctccttccatcccatccagctccttcccagctagccactcacaaccccgccatgggcctcagaattgctaaagggacatcagaccatactacacatcattagatctcaatgaagaacacctctagttggcccgtctctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcagaaggagagagtgattctgcccctcccgcctgggccccaaagtcccagttttgcaggggtcctgcctccccgggttggcctggagtggcagcagccatcccctgatactggctattaagtttctgcaggtgcatactagccagcaagtgaggggcggggtgcaggttgaaggatgggggtttagtgggaggggtggttgtaggagagcctattggagatcccgaggaactagtgggagccccactggccttggttccatttgaggctaccccagggtagtgcagaatggccactgctttgcgatctttcaccgcaaggttggagtaggccacggagctcatctcttggttggcatcctagaagacagagaaaagcacaccatagtaaccctgctcctggcttgtccttcaccattcagcagatttagaaggttcctacctgcacttcatttgggactagaggtggagaggtagcaagacgacccccttgaaaattaggctcccacctcaagcatccttttgctgccatggctctgagcactgaggccagagcccagttacagtgctggagcacctgccatcctaagtgggttcactgctttcagctccttccccatagcctccacctcaccatcctaaaaagggcacctcctgtccctcttctcagcctcactttagtctcttcaacagagtggttttgctcctactcaatttctctgctcccttccctgccatctttcaacacccctagtgggttcaatctgaccacaatttaggcagaagctgttctcattctccccagagatagtcctgttgtctcctctctgctcaaggacactgggtaatgcacctaggagggcctggcccatgaccccggaaaatttgtctttccctgcctcatctgtaaaatggcaaaaattacctccttcgcaggtgaggtgccacccttgacatcaagtgcaggcctcgacgttgttggcatttcagagccttggcagaagttggataaattggcgggaagtgatgctgccagctggag

SEQ ID NO: 3495 - DNA, 121161 bp, human; identical to SEQ ID NO: 3494

SEQ ID NO: 3496 - DNA, 5337 bp, human
acgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagaggtaagccgggccgccgggctgggcgccgggctgggcggcggggccgaggactcccgtggagcgggtatggggagtgggcggccgccaggcgggccggagggttctggggagacttgctttctgttggaaagctgctctgctgggggcgaggggccgcccgcccgcccgcccgccagcgctcgggttcgcttgccagcgcgcccccctgccggccagcggggccgggtgcccgcttctcccggggagacggcagcaccttttctccctgcgcccgcgctttctccagcttggcttccaccgactttgctaatctcccggaccgcatctggacgctctggctccggagctgcacaaagctcagatttacttcggggaattgaggcaagagggggcttttcgggccgagttcagcggaattgcgggatggaagttagcgaatttgggcaacttgcctctactgcccagtcgacctcagccctcccctcccccgacacacgcccacacacacacacccacgcgcacacccctctccctataaacgcgggctggcgagccgcgcgccgagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaa

SEQ ID NO: 3497 - DNA, 5512 bp, human
gcaccgctgagctgccgagaggaagctcgctctgcccggctgccctcttgtagtccgccggcgaggggcagttctcggtgaggaggaagagagcagcggacggcacagcacccgcgcgggccctccgtgagtatccagttcagattttgccaccaactcgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagaggtaagccgggccgccgggctgggcgccgggctgggcggcggggccgaggactcccgtggagcgggtatggggagtgggcggccgccaggcgggccggagggttctggggagacttgctttctgttggaaagctgctctgctgggggcgaggggccgcccgcccgcccgcccgccagcgctcgggttcgcttgccagcgcgcccccctgccggccagcggggccgggtgcccgcttctcccggggagacggcagcaccttttctccctgcgcccgcgctttctccagcttggcttccaccgactttgctaatctcccggaccgcatctggacgctctggctccggagctgcacaaagctcagatttacttcggggaattgaggcaagagggggcttttcgggccgagttcagcggaattgcgggatggaagttagcgaatttgggcaacttgcctctactgcccagtcgacctcagccctcccctcccccgacacacgcccacacacacacacccacgcgcacacccctctccctataaacgcgggctggcgagccgcgcgccgagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcca

SEQ ID NO: 3498 - DNA, 4701 bp, human
aaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagaggtaagccgggccgccgggctgggcgccgggctgggcggcggggccgaggactcccgtggagcgggtatggggagtgggcggccgccaggcgggccggagggttctggggagacttgctttctgttggaaagctgctctgctgggggcgaggggccgcccgcccgcccgcccgccagcgctcgggttcgcttgccagcgcgcccccctgccggccagcggggccgggtgcccgcttctcccggggagacggcagcaccttttctccctgcgcccgcgctttctccagcttggcttccaccgactttgctaatctcccggaccgcatctggacgctctggctccggagctgcacaaagctcagatttacttcggggaattgaggcaagagggggcttttcgggccgagttcagcggaattgcgggatggaagttagcgaatttgggcaacttgcctctactgcccagtcgacctcagccctcccctcccccgacacacgcccacacacacacacccacgcgcacacccctctccctataaacgcgggctggcgagccgcgcgccgagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaa

SEQ ID NO: 3499 - DNA, 5540 bp, human
ctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctccgtgagtatccagttcagattttgccaccaactcgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagaggtaagccgggccgccgggctgggcgccgggctgggcggcggggccgaggactcccgtggagcgggtatggggagtgggcggccgccaggcgggccggagggttctggggagacttgctttctgttggaaagctgctctgctgggggcgaggggccgcccgcccgcccgcccgccagcgctcgggttcgcttgccagcgcgcccccctgccggccagcggggccgggtgcccgcttctcccggggagacggcagcaccttttctccctgcgcccgcgctttctccagcttggcttccaccgactttgctaatctcccggaccgcatctggacgctctggctccggagctgcacaaagctcagatttacttcggggaattgaggcaagagggggcttttcgggccgagttcagcggaattgcgggatggaagttagcgaatttgggcaacttgcctctactgcccagtcgacctcagccctcccctcccccgacacacgcccacacacacacacccacgcgcacacccctctccctataaacgcgggctggcgagccgcgcgccgagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaga

SEQ ID NO: 3500 - DNA, 214 bp, human
agggctatactttcaggggtaatttctatagttcattactagagtagtttctctgaatgtgtagggtgccagaaaccacaaggaggaggcacagcattctctagtgagtgtgaagccggctgttggtgttgcttcgctgaaactgccatttgccactgataatcgttcttcttttccatcaggagactaagaggtagaaaacgcagtctgagtg
